US010808011B2

(12) United States Patent
Lusso et al.

(10) Patent No.: US 10,808,011 B2
(45) Date of Patent: Oct. 20, 2020

(54) RECOMBINANT HIV-1 ENVELOPE PROTEINS AND THEIR USE

(71) Applicant: The United States of America, as represented by the Secretary, Department of Health and Human Services, Behtesda, MD (US)

(72) Inventors: Paolo Lusso, Rockville, MD (US); Peng Zhang, Rockville, MD (US)

(73) Assignee: The United States of America, as represented by the Secretary, Department of Health & Human Services, Bethesda, MD (US)

( * ) Notice: Subject to any disclaimer, the term of this patent is extended or adjusted under 35 U.S.C. 154(b) by 0 days.

(21) Appl. No.: 16/083,359

(22) PCT Filed: Mar. 9, 2017

(86) PCT No.: PCT/US2017/021573
§ 371 (c)(1),
(2) Date: Sep. 7, 2018

(87) PCT Pub. No.: WO2017/156272
PCT Pub. Date: Sep. 14, 2017

(65) Prior Publication Data
US 2019/0085032 A1 Mar. 21, 2019

Related U.S. Application Data

(60) Provisional application No. 62/306,006, filed on Mar. 9, 2016.

(51) Int. Cl.

| | |
|---|---|
| *A61K 39/00* | (2006.01) |
| *A61K 39/21* | (2006.01) |
| *A61K 39/12* | (2006.01) |
| *C07K 14/005* | (2006.01) |
| *C07K 16/10* | (2006.01) |

(52) U.S. Cl.
CPC ............ *C07K 14/005* (2013.01); *A61K 39/12* (2013.01); *A61K 39/21* (2013.01); *C07K 2319/00* (2013.01); *C12N 2740/16022* (2013.01); *C12N 2740/16034* (2013.01); *C12N 2740/16122* (2013.01); *C12N 2740/16134* (2013.01)

(58) Field of Classification Search
CPC ........ C07K 14/005; C12N 2740/16122; A61P 31/18; A61K 39/12; A61K 39/21
See application file for complete search history.

(56) References Cited

U.S. PATENT DOCUMENTS

| | | | | |
|---|---|---|---|---|
| 10,058,604 B2 * | 8/2018 | Wyatt | ...................... | C12N 7/00 |
| 2014/0212458 A1 | 7/2014 | Caulfield et al. | | |

FOREIGN PATENT DOCUMENTS

| | | | |
|---|---|---|---|
| EP | 2765138 A2 | | 8/2014 |
| EP | 2873423 A2 | | 5/2015 |
| WO | WO 2013/189901 A1 | | 12/2013 |
| WO | WO2013189901 | * | 12/2013 |
| WO | WO 2016/037154 A1 | | 3/2016 |

OTHER PUBLICATIONS

Bartesaghi, et al. "Prefusion structure of trimeric HIV-1 envelope glycoprotein determined by cryo-electron microscopy." *Nature Structural & Molecular Biology* 20, No. 12 (2013): 1352.
De Taeye, et al. "Immunogenicity of stabilized HIV-1 envelope trimers with reduced exposure of non-neutralizing epitopes." *Cell* 163, No. 7 (2015): 1702-1715.
Garces, et al. "Affinity maturation of a potent family of HIV antibodies is primarily focused on accommodating or avoiding glycans." *Immunity* 43, No. 6 (2015): 1053-1063.
Julien, et al. "Crystal structure of a soluble cleaved HIV-1 envelope trimer." *Science* (2013): 1477-1483.
Kassa, et al. "Stabilizing exposure of conserved epitopes by structure guided insertion of disulfide bond in HIV-1 envelope glycoprotein." *PloS One* 8, No. 10 (2013): e76139.
Kwon, et al. "Crystal structure, conformational fixation and entry-related interactions of mature ligand-free HIV-1 Env." *Nature Structural & Molecular Biology* 22, No. 7 (2015): 522.
Kwong, et al. "Structure of an HIV gp120 envelope glycoprotein in complex with the CD4 receptor and a neutralizing human antibody." *Nature* 393, No. 6686 (1998): 648.
Kwong, et al. "HIV-1 evades antibody-mediated neutralization through conformational masking of receptor-binding sites." *Nature* 420, No. 6916 (2002): 678.
Lyumkis, et al. "Cryo-EM structure of a fully glycosylated soluble cleaved HIV-1 envelope trimer." *Science* 342, No. 6165 (2013): 1484-1490.
Pancera, et al. "Structure and immune rrcogmtion of trimeric pre-fusion HIV-1 Env." *Nature* 514, No. 7523 (2014): 455.
Rerks-Ngarm, et al. "Vaccination with ALVAC and AIDSVAX to prevent HIV-1 infection in Thailand." *New England Journal of Medicine* 361, No. 23 (2009): 2209-2270.
Sanders, et al. "A next-generation cleaved, soluble HIV-1 Env trimer, BG505 SOSIP. 664 gp140, expresses multiple epitopes for broadly neutralizing but not non-neutralizing antibodies." *PLoS Pathogens* 9, No. 9 (2013): e1003618.
Zhang, et al. "Interdomain stabilization impairs CD4 binding and improves immunogenicity of the HIV-1 envelope trimer." *Cell Host & Microbe* 23, No. 6 (2018): 832-844, and including supplementary information.

(Continued)

*Primary Examiner* — Barry A Chestnut

(74) *Attorney, Agent, or Firm* — Klarquist Sparkman, LLP

(57) ABSTRACT

Embodiments of HIV-1 Env ectodomain trimers stabilized in a prefusion mature closed conformation and methods of their use and production are disclosed. Nucleic acid molecules encoding the HIV-1 Env ectodomain trimers are also provided. In several embodiments, the HIV-1 Env ectodomain trimers and/or nucleic acid molecules can be used to generate an immune response to HIV-1 in a subject, for example, to treat or prevent an HIV-1 infection in the subject.

33 Claims, 27 Drawing Sheets

Specification includes a Sequence Listing.

(56) References Cited

OTHER PUBLICATIONS

Zhou, et al. "Structural definition of a conserved neutralization epitope on HIV-1 gp120." *Nature* 445, No. 7129 (2007): 732-737, and including supplementary information.

* cited by examiner

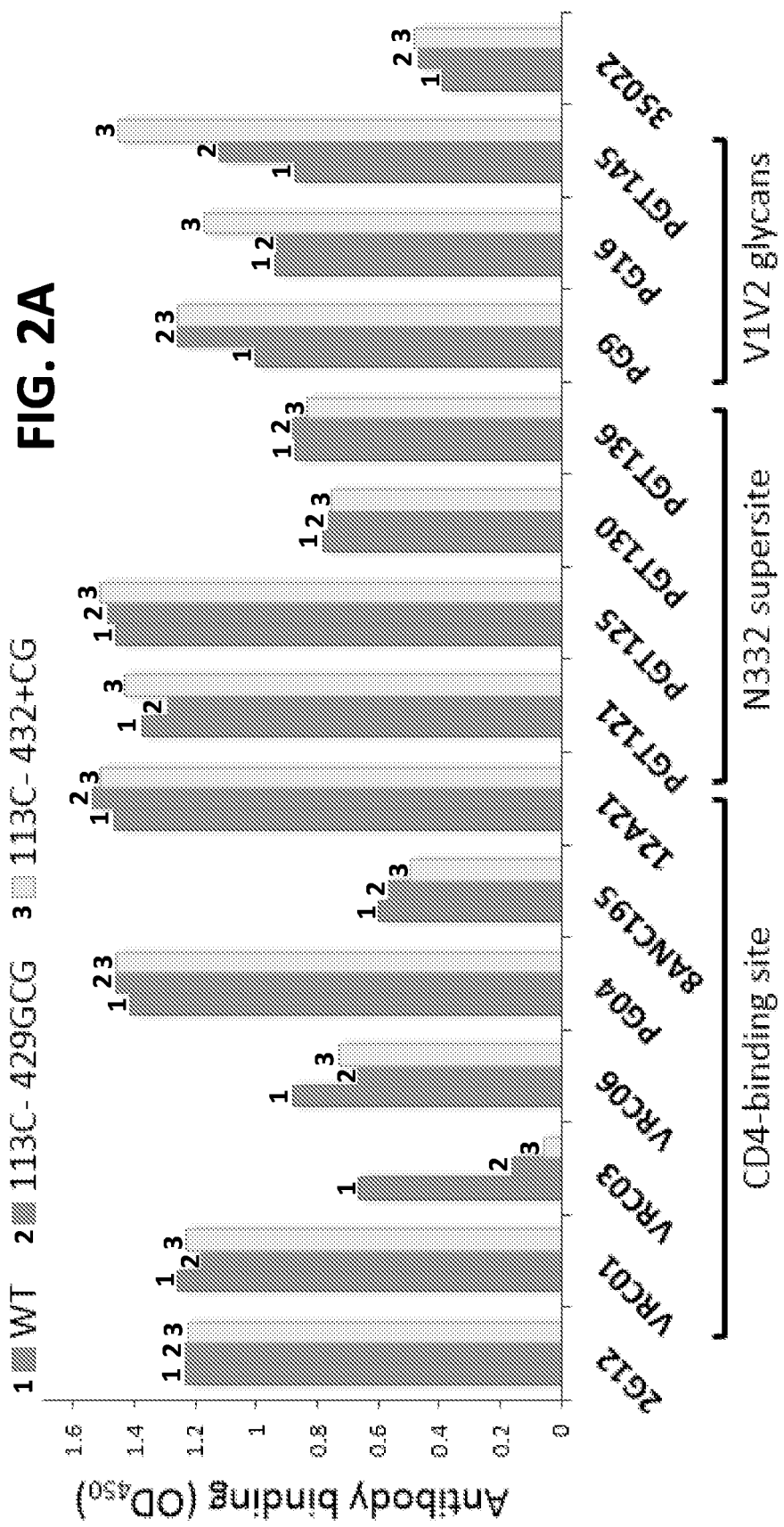

FIG. 4B

Human CD4: aa. 60-64

MNRGVPFRHL LLVLQLALLP AATQGKKVVL GKKGDTVELT CTASQKKSIQ FHWKNSNQIK
ILGNQGSFLT KGPSKLNDRA DSRRSLWDQG NFPLIIKNLK IEDSDTYICE VEDQKEEVQL
LVFGLTANSD THLLQGQSLT LTLESPPGSS PSVQCRSPRG KNIQGGKTLS VSQLELQDSG
TWTCTVLQNQ KKVEFKIDIV VLAFQKASSI VYKKEGEQVE FSFPLAFTVE KLTGSGELWW
QAERASSSKS WITFDLKNKE VSVKRVTQDP KLQMGKKLPL HLTLPQALPQ YAGSGNLTLA
LEAKTGKLHQ EVNLVVMRAT QLQKNLTCEV WGPTSPKLML SLKLENKEAK VSKREKAVWV
LNPEAGMWQC LLSDSGQVLL ESNIKVLPTW STPVQPMALI VLGGVAGLLL FIGLGIFFCV
RCRHRRRQAE RMSQIKRLLS EKKTCQCPHR FQKTCSPI

HIV-1 gp120: aa. 110-114

MRVTEIRKSY QHWWRWGIML LGILMICNAE EKLWVTVYYG VPVWKEATTT LFCASDAKAY
DTEVHNVWAT HACVPTDPNP QEVALENVTE NFNMWKNNMV EQMHEDIISL WDQSLKPCVK
LTPLCVTLNC TDLRNATSRN VTNTTSSSRG MVGGGEMKNC SFNITTGIRG KVQKEYALFY
ELDIVPIDNK IDRYRLISCN TSVITQACPK VSFEPIPIHY CAPAGFAILK CKDKKFNGKG
PCSNVSTVQC THGIRPVVST QLLLNGSLAE EEVVIRSENF TNNAKTIIVQ LNESVEINCT
RPNNNTRKSI NIGPGRAFYT TGEIIGDIRQ AHCNLSRAKW NDTLNKIVIK LREQFGNKTI
VFKHSSGGDP EIVTHSFNCG GEFFYCNSTQ LFNSTWNVTE ESNNTVENNT ITLPCRIKQI
INMWQEVGRA MYAPPIRGQI RCSSNITGLL LTRDGGPEDN KTEVFRPGGG DMRDNWRSEL
YKYKVVKIEP LGVAPTKAKR RVVQREKR

Clade A  LNMWQRXGQAMY
Clade B  LNMWQEVGKAMY
Clade C  LNMWQEVGRAMY
Clade D  LNMWQGVGKAMY
Clade E  LNMWQGXGQAMY
Clade F  YNMWQEVGRAMY
Clade G  VRMWQRVGQAMY

FIG. 6A

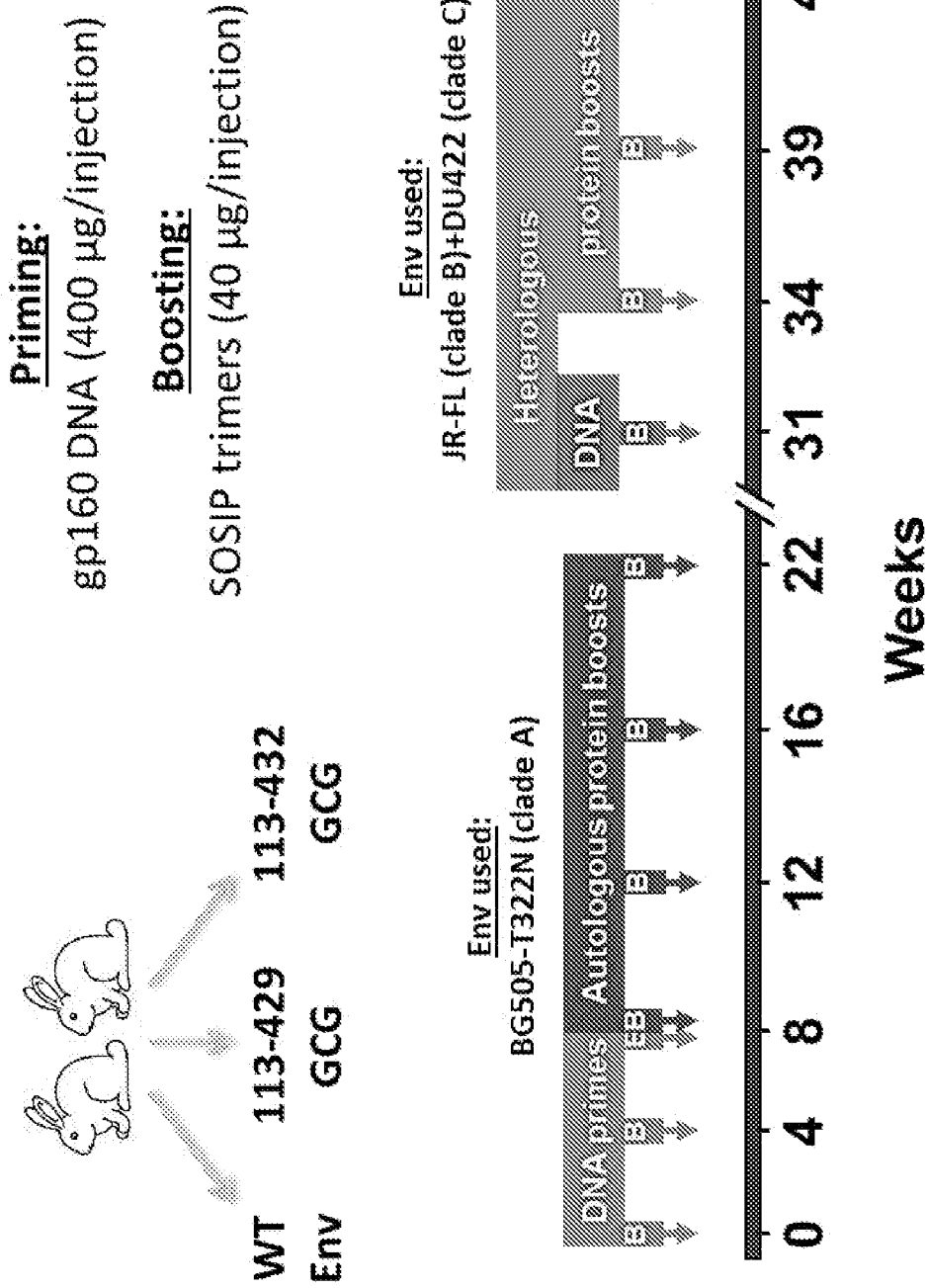

FIG. 11B

Start heterologous boosts ↓

| Virus | Clade | Tier | Rab. #50 | | | | | | |
|---|---|---|---|---|---|---|---|---|---|
| | | | T0 | T3 | T5 | T6 | T7 | T8 | T9 |
| VSV | na | na | <10 | <10 | <10 | <10 | <10 | <10 | <10 |
| BaL | B | 1B | <10 | | <10 | | 80 | 126 | 524 |
| BG505 | A | 2 | <10 | 20 | 245 | | 126 | 84 | 99 |
| Q168 | A | 2 | <10 | <10 | <10 | <10 | <10 | 23 | 177 |
| Q769 | A | 2 | <10 | | | | <10 | 156 | 59 |
| UG037 | A | 2 | <10 | | <10 | | | | 71 |
| JR-FL | B | 2 | <10 | | <10 | | <10 | 10 | 18 |
| JR-CSF | B | 2 | <10 | <10 | <10 | <10 | <10 | 67 | 270 |
| YU2 | B | 2 | <10 | | <10 | | <10 | 85 | 355 |
| AD8 | B | 2 | <10 | | | | | | 131 |
| CAAN | B | 2 | <10 | 20 | <10 | <10 | <10 | 23 | 315 |
| WITO | B | 2 | <10 | | | | <10 | 328 | |
| TRO11 | B | 2 | <10 | | | | <10 | 67 | |
| PVO | B | 3 | <10 | | | | <10 | 146 | 397 |
| CH505 | C | 2 | <10 | | <10 | | | | 47 |
| DU156 | C | 2 | <10 | | | | <10 | 81 | 144 |
| ZM106 | C | 2 | <10 | <10 | <10 | <10 | <10 | 20 | 20 |
| QD435 | D | 2 | <10 | | <10 | | 28 | 36 | 242 |
| 92THA | E | 2 | <10 | | | | | 73 | |
| C1080c | E | 2 | <10 | | | | | | 91 |

RECOMBINANT HIV-1 ENVELOPE PROTEINS AND THEIR USE

CROSS REFERENCE TO RELATED APPLICATIONS

This is the U.S. National Stage of International Application No. PCT/US2017/021573, filed Mar. 9, 2017, which was published in English under PCT Article 21(2), which in turn claims the benefit of U.S. Provisional Application No. 62/306,006, filed Mar. 9, 2016. The provisional application is incorporated by reference herein in its entirety.

FIELD

This disclosure relates to recombinant Human immunodeficiency virus type 1 (HIV-1) gp120 proteins and HIV-1 Envelope (Env) ectodomain trimers including the recombinant gp120 proteins for treatment and inhibition of HIV-1 infection and disease.

BACKGROUND

Millions of people are infected with HIV-1 worldwide, and 2.5 to 3 million new infections have been estimated to occur yearly. Although effective antiretroviral therapies are available, millions succumb to AIDS every year, especially in sub-Saharan Africa, underscoring the need to develop measures to prevent the spread of this disease.

An enveloped virus, HIV-1 hides from humoral recognition behind a wide array of protective mechanisms. The major envelope protein of HIV-1 is a glycoprotein of approximately 160 kD (gp160). During infection, proteases of the host cell cleave gp160 into gp120 and gp41. Gp41 is an integral membrane protein, while gp120 protrudes from the mature virus. Together gp120 and gp41 make up the HIV-1 envelope spike, which is a target for neutralizing antibodies.

It is believed that immunization with an effective immunogen based on HIV-1 Env can elicit a neutralizing response, which may be protective against HIV-1 infection. However, despite extensive effort, a need remains for agents capable of such action.

SUMMARY

This disclosure provides novel recombinant HIV-1 Env trimers (such as soluble HIV-1 Env ectodomain trimers and membrane-anchored HIV-1 Env ectodomain trimers including a full-length gp41 protein) that include one or more amino acid substitutions and/or insertions that "lock" the recombinant HIV-1 Env trimer in a conformation that does not bind to CD4, but does bind to broadly neutralizing antibodies, including trimer-specific broadly neutralizing antibodies. In several embodiments, the recombinant HIV-1 Env trimer is stabilized in a prefusion mature closed conformation by the one or more amino acid substitutions and/or insertions.

Identification of the disclosed recombinant HIV-1 Env trimers was based on the elucidation of a structural transition that gp120 in the trimeric HIV-1 Env ectodomain undergoes upon CD4 binding. Introducing a non-native disulfide bond to prevent the CD4-induced transition prevents CD4 binding to gp120, and also "locks" the gp120 inner and outer domains in a non-flexible state which (as disclosed herein) stabilizes epitopes of broadly neutralizing antibodies, while minimizing surface exposure of epitopes targeted by weakly or non-neutralizing antibodies. Accordingly, the disclosed recombinant HIV-1 Env trimers can be used as immunogens and are optimized for induction of a neutralizing immune response to HIV-1. Indeed, immunization studies presented herein show that embodiments of the disclosed immunogens can induce a tier-2 cross-Clade neutralizing immune response in an animal model.

In some embodiments, an immunogen is provided that comprises a recombinant HIV-1 Env ectodomain trimer (such as a soluble HIV-1 Env ectodomain trimer or a membrane-anchored HIV-1 Env ectodomain trimer including a full-length gp41 protein) comprising a recombinant gp120 protein comprising a first non-natural disulfide bond between a cysteine residue in an α1 helix of the gp120 protein and a cysteine residue in a β20-β21 region of the gp120 protein. The cysteine residues are introduced by amino acid substitution and/or insertion, and the recombinant HIV-1 Env ectodomain trimer does not specifically bind to CD4. In some embodiments, the first non-natural disulfide bond is between a cysteine substitution introduced at one of HIV-1 Env positions 106-118 (such as HIV-1 Env positions 108-115), and a cysteine substitution or insertion introduced at one of (or between two of) HIV-1 Env positions 423-435 (such as HIV-1 Env positions 427-432), wherein the HIV-1 Env positions correspond to a HIV-1 Env HXB2 reference sequence set forth as SEQ ID NO: 1.

In some embodiments, the first non-natural disulfide bond can be between a cysteine substitution at HIV-1 Env position 113 of the α1 helix, and a cysteine substitution at HIV-1 Env position 429 of the β20-β21 region. In some such embodiments, the recombinant gp120 protein can further comprise an amino acid insertion (such as a glycine insertion or a glycine-serine insertion) on either side of the cysteine substituted at position 429. In some embodiments, the first non-natural disulfide bond can be between a D113C substitution in the α1 helix and one of a R429GCG, a E429GCG, a G429GCG, or a K429GCG substitution (depending on HIV-1 strain) in the β20-β21 region.

In some embodiments, the first non-natural disulfide bond can be between a cysteine substitution at HIV-1 Env position 113 of the α1 helix, and a cysteine substitution at HIV-1 Env position 432 of the β20-β21 region. In some such embodiments, the recombinant gp120 protein can further comprise an amino acid insertion (such as a glycine insertion or a glycine-serine insertion) on either side of the cysteine substituted at position 432. In some embodiments, the first non-natural disulfide bond can be between a D113C substitution in the α1 helix and one of a Q429GCG, a R429GCG, or a K429GCG, or (depending on HIV-1 strain) in the β20-β21 region.

In some embodiments, the first non-natural disulfide bond can be between a cysteine substitution at HIV-1 Env position 113 of the α1 helix, and a cysteine insertion between HIV-1 Env positions 431 and 432 of the β20-β21 region. In some such embodiments, the recombinant gp120 protein can further comprise an amino acid insertion (such as a glycine insertion or a glycine-serine insertion) between position 432 and the cysteine inserted between positions 431 and 432. In some embodiments, the first non-natural disulfide bond can be between a D113C substitution in the α1 helix and a G431GCG substitution in the β20-β21 region.

In some embodiments, the first non-natural disulfide bond can be between a cysteine substitution at HIV-1 Env position 116 or 117 of the α1 helix, and a cysteine insertion between HIV-1 Env positions 431 and 432 or between HIV-1 Env positions 433 and 434 of the β20-β21 region. In some embodiments, the first non-natural disulfide bond can be between a cysteine substitution at HIV-1 Env position 108 or 109 of the α1 helix, and a cysteine substitution at HIV-1 Env position 427 of the β20-β21 region. The gp120 protein can further comprise insertion of one or two spacer amino acids immediately N- and/or C-terminal the cysteine residues introduced by amino acid substitution or insertion.

In some embodiments, an immunogen is provided that comprises a recombinant HIV-1 Env ectodomain trimer (such as a soluble HIV-1 Env ectodomain trimer or a membrane-anchored HIV-1 Env ectodomain trimer including a full-length gp41 protein) comprising a recombinant gp120 protein comprising a second non-natural disulfide bond between a cysteine residue in an α1 helix and a cysteine residue in an α5 helix of the recombinant gp120 protein. The cysteine residues are introduced by amino acid substitution and/or insertion, and the recombinant HIV-1 Env ectodomain trimer does not specifically bind to CD4. In some embodiments, the second non-natural disulfide bond is between a cysteine substitution introduced at one of HIV-1 Env positions 99-105 of the α1 helix, and a cysteine substitution at one of HIV-1 Env positions 474-483 of the α5 helix, wherein the HIV-1 Env positions correspond to a HIV-1 Env HXB2 reference sequence set forth as SEQ ID NO: 1.

The recombinant HIV-1 Env ectodomain trimer can optionally include the first non-natural disulfide bond, the second non-natural disulfide bond, or the first and the second non-natural disulfide bonds to be stabilized in the conformation that does not bind to CD4, but does bind to broadly neutralizing antibodies (including trimer-specific broadly neutralizing antibodies) and/or the prefusion mature closed conformation.

In some embodiments, the recombinant HIV-1 Env ectodomain trimer is cleavable between gp120 and gp41. In other embodiments, the recombinant HIV-1 Env ectodomain trimer is not cleavable between gp120 and gp41, and the cleavage site is replaced by an amino acid linker of a length allowing for the correct folding of the gp120-gp41 protomers in the HIV-1 Env ectodomain timer. In some embodiments, the HIV-1 Env ectodomain trimer and can be further stabilized by additional modifications, for example, by incorporation of one or more stabilizing mutations, such as a non-natural disulfide bond between cysteine substitutions at HIV-1 Env positions 201 and 433 (e.g., I201C and A433C substitutions), a non-natural disulfide bond between cysteine substitutions at HIV-1 Env positions 501 and 605 (for example, A501C and T605C substitutions), and/or a proline substitution at gp41 position 559 (for example, an I559P substitution).

In additional embodiments, a recombinant gp120 protein, a recombinant gp140 protein, a recombinant gp145 protein, and/or a recombinant gp160 protein comprising any of the disclosed mutations (such as the first or second non-natural disulfide bond discussed above) for stabilizing HIV-1 Env in its prefusion mature closed conformation, is provided.

Nucleic acid molecules encoding the disclosed immunogens are also provided. In some embodiments, the nucleic acid molecule can encode a precursor protein of a gp120-gp41 protomer of a disclosed recombinant HIV-1 Env trimer. Expression vectors (such as an inactivated or attenuated viral vector) including the nucleic acid molecules are also provided.

Compositions including the disclosed immunogens are also provided. The composition may be a pharmaceutical composition suitable for administration to a subject, and may also be contained in a unit dosage form. The compositions can further include an adjuvant. The recombinant HIV-1 Env ectodomain trimer may also be conjugated to a carrier to facilitate presentation to the immune system.

Methods of generating an immune response to HIV-1 envelope protein in a subject are disclosed, as are methods of treating, inhibiting or preventing an HIV-1 infection in a subject. In such methods a subject, such as a human subject, is administered an effective amount of a disclosed immunogen to elicit the immune response. The subject can be, for example, a human subject at risk of or having an HIV-1 infection.

The foregoing and other features and advantages of this disclosure will become more apparent from the following detailed description of several embodiments which proceeds with reference to the accompanying figures.

BRIEF DESCRIPTION OF THE FIGURES

FIGS. 2A-2H illustrate the reactivity of wild-type (WT) and disulfide-bond stabilized HIV-1 envelope trimers with a panel of anti-envelope antibodies. (FIG. 2A) ELISA reactivity of WT and mutated BG505-SOSIP.664 trimers with broadly and potently neutralizing antibodies (left panel) and poorly/non-neutralizing antibodies (right panel). OD450 values for antibodies at 2 μg/ml are presented. (FIG. 2B) Dose-response ELISA reactivity of WT and mutated BG505-SOSIP.664 trimers with selected broadly and potently neutralizing antibodies. (FIG. 2C) ELISA reactivity of WT and mutated BG505-SOSIP.664 trimers with two molecular forms of sCD4, 4-domain sCD4 and the chimeric CD4-Ig. (FIG. 2D) ELISA reactivity of WT and mutated BG505-SOSIP.664 trimers with antibodies against CD4-induced epitopes tested both in the absence and in the presence of soluble CD4 (sCD4) at 5μg/ml. (FIG. 2E) Surface plasmon resonance (SPR) binding of WT and mutated BG505-SOSIP.664 trimers with 2-domain sCD4. Binding parameters are shown only for the WT trimer because no detectable binding was observed for the 2 mutants. (FIG. 2F) Thermal stability analysis of WT and mutated BG505-SOSIP.664 trimers by DTC. (FIG. 2G) Negative-staining electron microscopy (NS-EM) analysis of WT and mutated BG505-SOSIP.664 trimers. (FIG. 2H) Three-dimensional reconstructions of WT and mutated BG505-SOSIP.664 trimers performed on negative-staining electron microscopy (NS-EM) images. (FIG. 3C) Infectivity of HIV-1 viral pseudotypes bearing the WT and mutated envelope proteins.

FIGS. 4A-4C show envelope binding and neutralizing activity of sera from rabbits immunized with wild-type (WT) or interdomain stabilized HIV-1 envelope trimers. (FIG. 4A) ELISA reactivity of sera obtained from rabbits immunized with WT or disulfide-bond stabilized HIV-1 envelope trimers with monomeric gp120 from homologous (BG505) and heterologous (BaL) HIV-1 strains, as well as with the homologous BG505-SOSIP.664 trimer. (FIG. 4B) Neutralization of homologous and heterologous tier-1 and tier-2 HIV-1 strains by sera from rabbits immunized with WT or disulfide-bond stabilized HIV-1 envelope trimers. The animals were immunized using a prime-boost protocol, with three injections of DNA (gp160) with an electroporation device (AgilePulse) followed by three protein (SOSIP) injections. The assays were performed using viral pseudotypes expressing the respective HIV-1 envelopes using the standard TZMbl method. (FIG. 4C) Sera binding to V3 peptides from the Bal and BG505 strains.

FIGS. 5A-5D illustrate the molecular mimicry model between the SLWDQ regions of gp120 and CD4. (FIG. 5A) Location of the SLWDQ segments in the gp120 (residues 1-511 of SEQ ID NO: 2) and CD4 (SEQ ID NO: 17) sequence. (FIG. 5B) Overlap of the three-dimensional structures of the SLWDQ regions of gp120 and CD4 (PDB ID numbers indicated over the figures). (FIG. 5C) Intramolecular salt-bridge interaction between R429 in the β20-21 loop and D113 in the SLWDQ region of gp120, as seen in the crystal structure of the BG505-SOSIP.664 trimer (Julien et al., *Science,* 342, 1477-1483, 2013; Pancera et al., *Nature,* 514, 455-461, 2014; Kwon et al., *Nat. Struct. Mol. Biol.,* 22, 522-531, 2015; Garces et al., *Immunity,* 43, 1053-1063, 2015). (FIG. 5D) Intermolecular interaction between R429 in gp120 and D63 in the SLWDQ region of CD4, as predicted by molecular dynamic simulation of CD4 binding to the BG505-SOSIP.664 trimer; gp120 is depicted in light grey; gp41 in dark grey; CD4 in light brown.

FIGS. 6A and 6B are a set of diagrams illustrating the sequence conservation of the β20-β21 region of gp120 in different HIV-1 genetic clades. (FIG. 6A) Conservation of the β20-β21 region in gp120 within individual HIV-1 genetic clades. Positions 429 and 432 are highlighted. (FIG. 6B) Favorable location of a positively-charged amino acid at position 432 for forming a disulfide bond with D113 in the SLWDQ region of gp120.

FIG. 7 is a graph showing the reactivity of wild-type (WT) and mutated BG505-SOSIP.664 trimers with anti-envelope monoclonal antibodies. ELISA reactivity of WT and mutated BG505 with different anti-envelope monoclonal antibodies. OD450 values for antibodies at 2 μg/ml are presented.

FIGS. 8A-8C show mass spectrometry analysis and biophysical characteristics of purified mutated BG505-SOSIP.664 trimers. (FIG. 8A) Mass spectrometry identification of the expected disulfide bond in the 113C–432+CG mutant. In FIG. 8A, the amino acid sequences of SEQ ID NO: 26 residues 419-443 of SEQ ID NO: 26 (a), residues 97-120 of SEQ ID NO: 26 ((3), residues 192-206 of SEQ ID NO: 26 (γ),residues 1221-142 of SEQ ID NO: 26 (δ), and residues 148-157 of SEQ ID NO: 26 (ε) are shown. (FIG. 8B) Mass spectrometry identification of the expected disulfide bond in the 113C-429GCG mutant. In FIG. 8B, the amino acid sequences residues 427-443 of SEQ ID NO: 27 (α), residues 97-120 of SEQ ID NO: 27 (β), residues 192-206 of SEQ ID NO: 27 (γ), residues 1221-142 of SEQ ID NO: 27 (δ), and residues 148-157 of SEQ ID NO: 27 (ε) are shown. SDS-PAGE gel (upper left panel) showing homogeneity and electrophoretic mobility of the two mutants both with beta-mercaptoethanol (MW ~120 KD for gp120 and ~30 KD for the gp41 ectodomain) and without Beta-mercaptoethanol (MW ~140 KD). Antigenic profile of mutated and WT trimers (upper right panel) before and after negative selection by antibody 447-52D. Size-exclusion chromatography profiles (bottom panel) of wild-type BG505-SOSIP.664 and two locked mutants.

FIG. 9 shows the conformational changes between gp120 prefusion and CD4-bound state. The sequence of BG505gp120 (positions 31-511 of SEQ ID NO: 2) with secondary structure in the prefusion (red) and CD4-bound (yellow) conformation indicated with cylinders representing a-helix and arrows β-strands. Disordered residues are indicated by "X". Residues that move more than 3 Å between the prefusion and the CD4-bound conformations are shown with grey shadows.

FIGS. 10A and 10B show graphs of results of the reactivity of wild-type and disulfide-locked soluble SOSIP trimers from HIV-1 strain DU422 with a panel of broad and potent human neutralizing antibodies assessed by ELISA. The trimers contained C and GCG substitutions at positions 113 and 429, respectively (113C-429GCG), or C and GCG substitutions at positions 113 and 432, respectively (113C-432GCG).

FIGS. 11A and 11B show results of immunization assays using embodiments of the disclosed recombinant HIV-1 Env ectodomain trimers. (11A) Rabbit immunization protocol. (11B) Neutralization of HIV-1 pseudoviruses bearing Env from different clades and tiers of neutralization sensitivity by sequential sera from a rabbit immunized with disulfide-stabilized Env containing C and GCG substitutions at positions 113 and 429, respectively (113C-429GCG) using a DNA (full-length gp160)+protein (SOSIP soluble trimers) prime-boost protocol. The rabbit received initially three DNA priming and four booster protein injections of autologous Env (from HIV-1 BG505, Glade A, containing the 113C-429GCG mutations), followed by three boosts with a mixture of heterologous Envs from (HIV-1 JR-FL, Glade B and HIV-1 DU422, Glade C, containing the 113C-429GCG mutations). Neutralizing titers are color coded and denote the serum dilution yielding half-maximal neutralization (IC50) against each HIV-1 Env. T0-T9 indicate the time (months) of immunization.

SEQUENCES

The nucleic and amino acid sequences listed herein are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~700 kb), which was created on Sep. 4, 2018, and which is incorporated by reference herein. In the accompanying sequence listing:

SEQ ID NOs: 1-15 are the amino acid sequences of exemplary HIV-1 Env proteins.

SEQ ID NO: 16 is the amino acid sequence of a peptide linker.

SEQ ID NO: 17 is the amino acid sequence of human CD4.

SEQ ID NOs: 18-20 are the amino acid sequences of transmembrane domains.

SEQ ID NO: 21 is the amino acid sequence of a T4 fibritin trimerization domain.

SEQ ID NOs: 22-113 are the amino acid sequences of exemplary HIV-1 Env proteins containing one or more modifications for stabilization in a prefusion mature closed conformation.

SEQ ID NOs: 114-116 are exemplary nucleic acid sequences encoding HIV-1 Env proteins containing one or more modifications for stabilization in a prefusion mature closed conformation.

SEQ ID NOs: 117-118 are the amino acid sequences of furin cleavage sites.

DETAILED DESCRIPTION

A major obstacle to the development of a protective HIV-1 vaccine is the intrinsic flexibility of the viral envelope trimer, which conceals conserved neutralization epitopes via conformational masking. This remarkable plasticity of the viral envelope spike underlies the belated and inconsistent appearance of broadly neutralizing antibodies in HIV-infected individuals, as well as the failure of experimental vaccines to elicit such antibodies.

This disclosure provides novel mutations for the production of recombinant gp120 or gp160 proteins and HIV-1 Env ectodomain trimers that are "locked" in a conformation that does not bind to CD4, but does bind to broadly neutralizing antibodies (including trimer-specific broadly neutralizing antibodies) and thereby should focus the antibody response of a vaccine recipient exclusively toward highly conserved neutralization epitopes. Identification of the new mutations was based on the elucidation of a structural transition that HIV-1 gp120 undergoes upon CD4 binding.

Figure 5B:
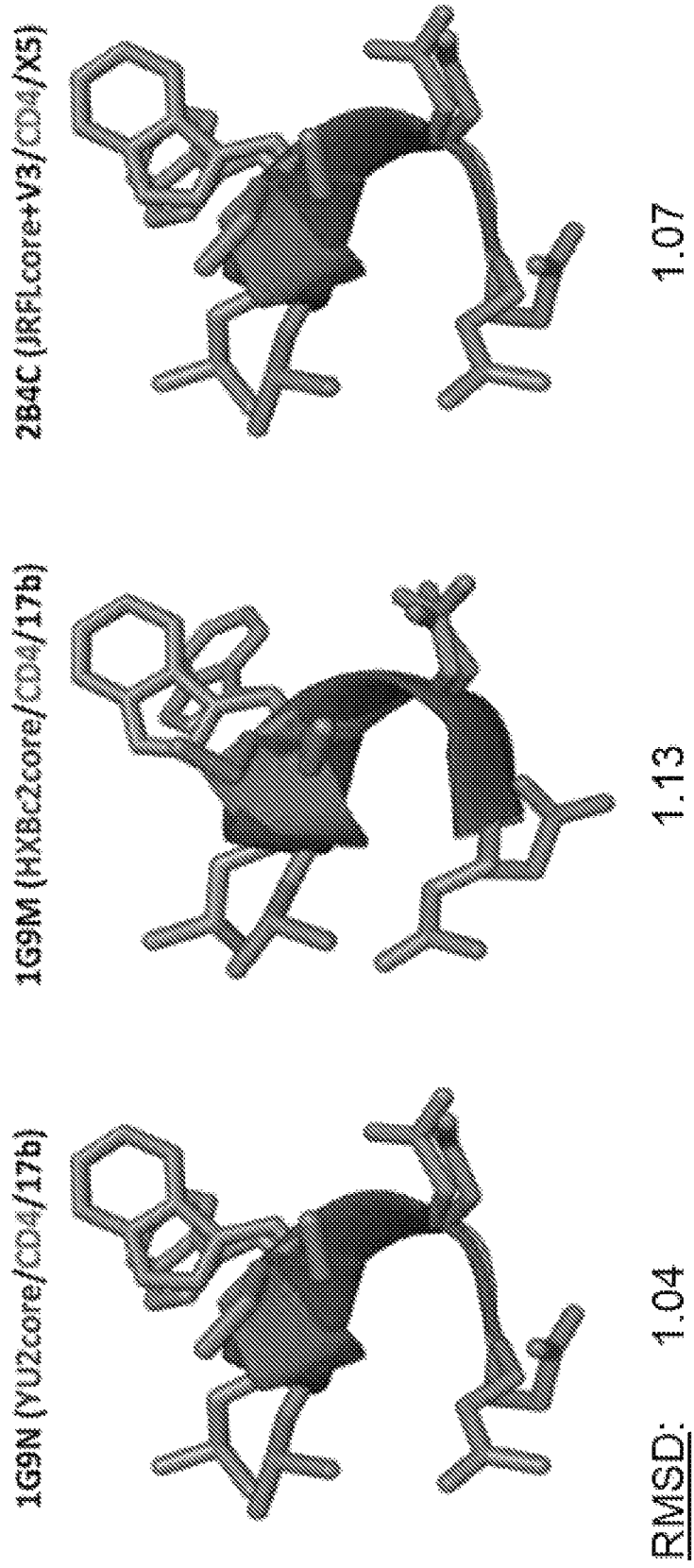
Figure 5C:
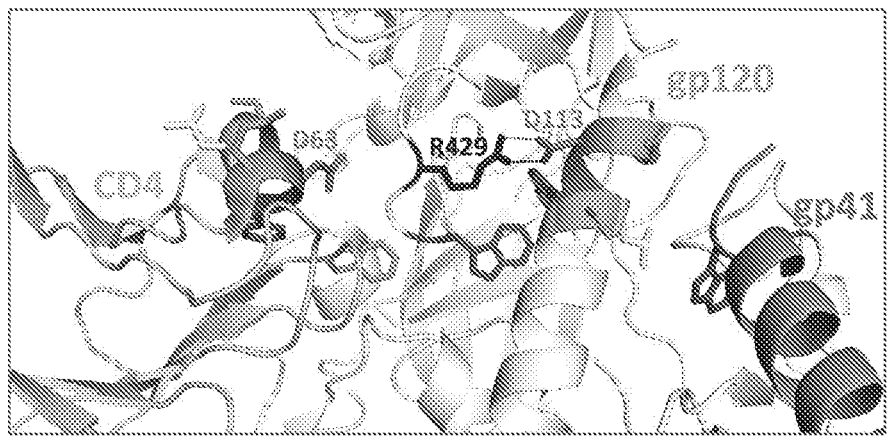
Figure 5D:
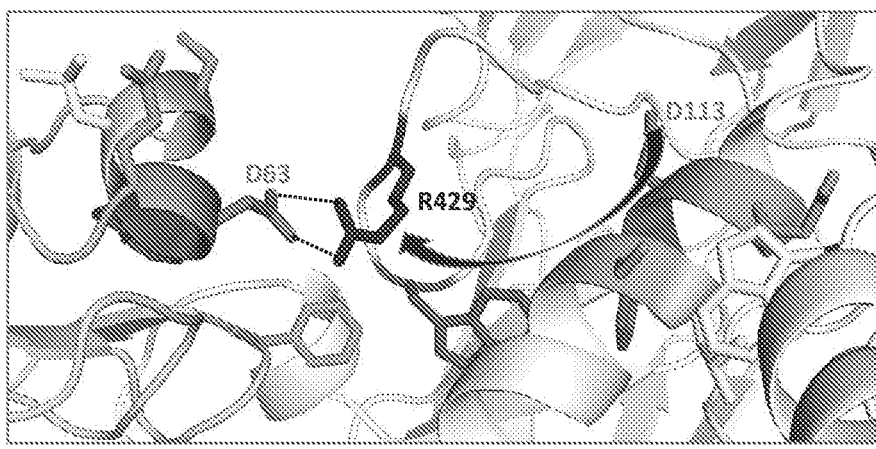
Figure 6B:
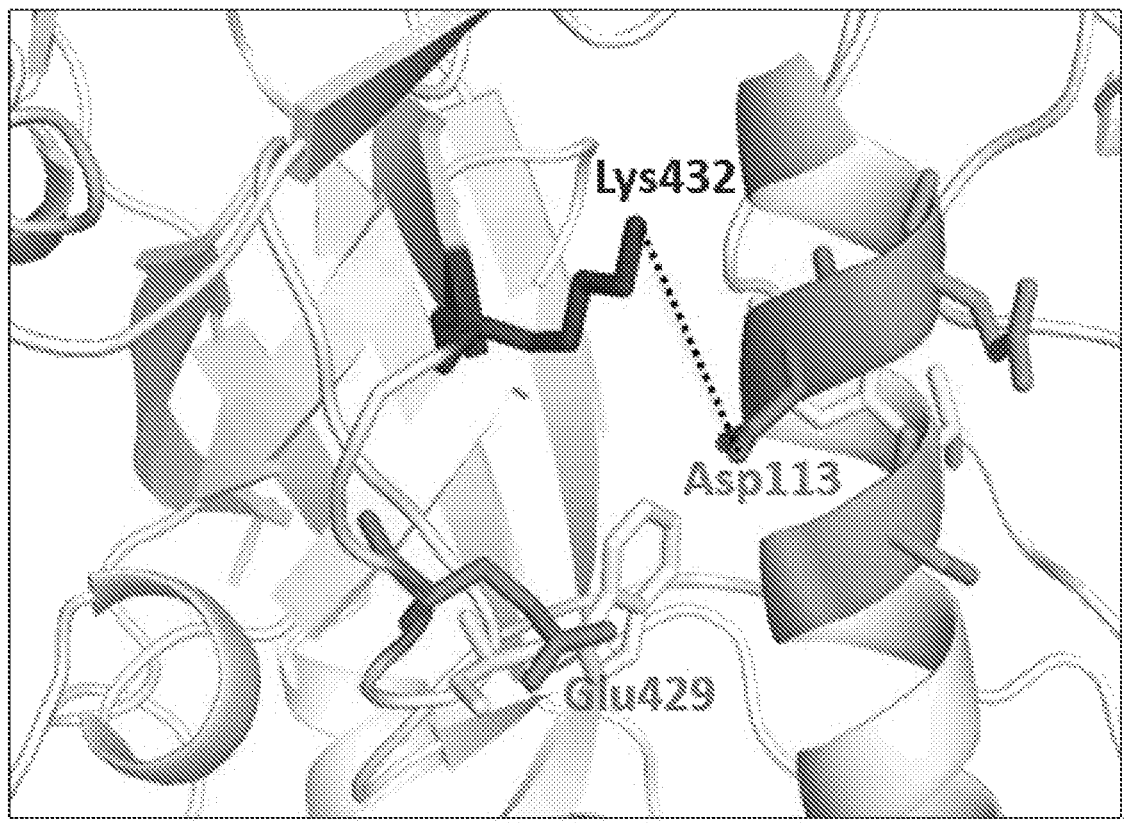

Two identical stretches of 5 amino acids (SLWDQ) in both HIV-1 gp120 (residues 110-114 in the C-terminal region of the α1-helix) and human CD4 (residues 60-64 in the DE loop of domain 1) (see FIG. 5A) share a high degree of structural homology, with both domains adopting a helical conformation with all-atom RMSD values of 1.04-1.13 for gp120 derived from different HIV-1 isolates (FIG. 5B). Since in the crystal structure of a native-like soluble gp140 trimer (BG505-SOSIP.664) D113 in the gp120 SLWDQ region forms a salt bridge with R429 in the (β20-(β21 loop (FIG. 5C), it was concluded that, upon binding to CD4, R429 switches outwards to form a salt bridge with D63 in the mimetic SLWDQ region of CD4 (FIG. 5D). Although R429 is almost exclusively present in Glade-A HIV-1 isolates, the vast majority of non-Glade-A isolates display a positively-charged residue (lysine or arginine) at position 432 (FIG. 6A), which is also favorably positioned to form a salt bridge with both gp120 D113 and CD4 D63 (FIG. 6B). Preventing the mechanistic transition would thus prevent CD4 binding to gp120, and also "lock" the gp120 inner and outer domains in a non-flexible state which (as disclosed herein) stabilizes epitopes of broadly neutralizing antibodies, while minimizing surface exposure of epitopes targeted by weakly neutralizing antibodies.

To prevent the mechanistic transition of the β20-β21 region forming a salt-bridge with CD4 and releasing the SLWDQ region of gp120 from intramolecular constraints, neo-disulfide bridges were introduced between the inner domain al-helix and the outer domain C4 region (specifically, the β20-β21 region) to stabilize the structure of both soluble cleaved gp140 trimers and full-length envelopes from diverse HIV-1 isolates. The disclosed mutations can readily be introduced into gp120 from different HIV-1 Clades to stabilize the gp120 or gp160, or an HIV-1 Ectodomain trimer including the recombinant gp120 in the conformation that does not bind to CD4 but does bind to broadly neutralizing antibodies.

Because the disclosed locked envelopes are stabilized in a rigid structure that selectively presents epitopes recognized by broadly and potently neutralizing antibodies, they can be used to induce a protective immune response to HIV-1 in a subject (such as a human). Further, the disruption of CD4 binding prevents sequestration of the immunogen by CD4+ T cells, which are not effective antigen-presenting cells.

Also, although the disclosed gp120 modifications prevent the CD4-gp120 interaction, the recombinant gp120 proteins (and HIV-1 Env trimers including the recombinant gp120 proteins) retain binding for broadly neutralizing antibodies that target the CD4 binding site (such as VRC01), thus leaving conformational epitopes accessible to the immune system for elicitation of CD4-binding site protective antibodies.

Given the combination of the above attributes, the disclosed recombinant gp120 proteins, and HIV-1 Env ectodomain trimers including the recombinant gp120 proteins are optimized for induction of a neutralizing immune response to HIV-1. Indeed, immunization studies presented in Example 1 show that embodiments of the disclosed immunogens can induce an immune response that neutralizes multiple tier-2 HIV-1 viruses from different HIV-1 Clades, an elusive result sought for decades, but not achieved until now.

I. Summary of Terms

Unless otherwise noted, technical terms are used according to conventional usage. Definitions of common terms in molecular biology may be found in Benjamin Lewin, *Genes X*, published by Jones & Bartlett Publishers, 2009; and Meyers et al. (eds.), *The Encyclopedia of Cell Biology and Molecular Medicine*, published by Wiley-VCH in 16 volumes, 2008; and other similar references.

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen." As used herein, the term "comprises" means "includes." It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described herein. In case of conflict, the present specification, including explanations of terms, will control. In addition, the materials, methods, and examples are illustrative only and not intended to be limiting. To facilitate review of the various embodiments, the following explanations of terms are provided:

Adjuvant: A vehicle used to enhance antigenicity. In some embodiments, an adjuvant can include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages). Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL and toll-like receptor (TLR) agonists, such as TLR-9 agonists. In some embodiments, the Adjuplex™ (Advanced BioAdjuvants) can be used with any of the recombinant gp120 proteins, or an HIV-1 Env ectodomain trimer including the recombinant gp120 proteins to elicit an immune response to HIV-1 Env. Additional description of Adjuvants can be found, for example, in Singh ((ed.) Vaccine (ed.) Vaccine Adjuvants and Delivery Systems.

Wiley-Interscience, 2007). Adjuvants can be used in combination with the disclosed immunogens.

Administration: The introduction of a composition into a subject by a chosen route. Administration can be local or systemic. For example, if the chosen route is intravenous, the composition (such as a composition including a disclosed immunogen) is administered by introducing the composition into a vein of the subject. Exemplary routes of administration include, but are not limited to, oral, injection (such as subcutaneous, intramuscular, intradermal, intraperitoneal, and intravenous), sublingual, rectal, transdermal (for example, topical), intranasally, vaginal, and inhalation routes.

Amino acid substitution and insertion: An amino acid substitution is the replacement of one amino acid in a polypeptide with a different amino acid. In some examples, an amino acid in a polypeptide is substituted with an amino acid from a homologous polypeptide, for example, an amino acid in a recombinant Clade A HIV-1 Env polypeptide can be substituted with the corresponding amino acid from a Clade B HIV-1 Env polypeptide. An amino acid insertion is the insertion of a new amino acid between two existing amino acids in a polypeptide. For simplicity, an amino acid insertion can sometimes be referred to using language of substitution; for example, reference to a "G431GCG substitution" in an HIV-1 gp120 protein refers to insertion of two amino acids (cysteine-glycine) immediately C-terminal to a glycine residue at position 431 of the HIV-1 gp120 protein.

Antibody: An immunoglobulin, antigen-binding fragment, or derivative thereof, that specifically binds and recognizes an analyte (antigen), such as HIV-1 gp120, an antigenic fragment thereof, or a dimer or multiple of the antigen. The term "antibody" is used herein in the broadest sense and encompasses various antibody structures, including but not limited to monoclonal antibodies, polyclonal antibodies, multi specific antibodies (e.g., bi specific antibodies), and antibody fragments, so long as they exhibit the desired antigen-binding activity. Non-limiting examples of antibodies include, for example, intact immunoglobulin and variants and fragments thereof known in the art that retain binding affinity for the antigen. Examples of antibody fragments include but are not limited to Fv, Fab, Fab', Fab'-SH, $F(ab')_2$; diabodies; linear antibodies; single-chain antibody molecules (e.g. scFv); and multi specific antibodies formed from antibody fragments. Antibody fragments include antigen binding fragments either produced by the modification of whole antibodies or those synthesized de novo using recombinant DNA methodologies (see, e.g., Kontermann and Dubel (Ed), Antibody Engineering, Vols. 1-2, 2$^{nd}$ Ed., Springer Press, 2010). Light and heavy chain variable regions contain a "framework" region interrupted by three hypervariable regions, also called "complementarity-determining regions" or "CDRs" (see, e.g., Kabat et al., *Sequences of Proteins of Immunological Interest,* U.S. Department of Health and Human Services, 1991). The framework region of an antibody, that is the combined framework regions of the constituent light and heavy chains, serves to position and align the CDRs in three-dimensional space. The CDRs are primarily responsible for binding to an epitope of an antigen.

CD4: Cluster of differentiation factor 4 polypeptide; a T-cell surface protein that mediates interaction with the MHC class II molecule. CD4 also serves as the primary receptor site for HIV-1 on T-cells during HIV-1 infection. CD4 is known to bind to gp120 from HIV-1 Env. The sequence of the CD4 precursor has a hydrophobic signal peptide, an extracellular region of approximately 370 amino acids, a highly hydrophobic stretch with significant identity to the membrane-spanning domain of the class II MHC beta chain, and a highly charged intracellular sequence of 40 resides (Maddon, *Cell* 42:93, 1985). The amino acid sequence of human CD4 is deposited in GenBank as No. P01730.1. Several embodiments utilize soluble CD4 (sCD4), which includes the extracellular domain of CD4 (without the signal peptide), approximately CD4 amino acids 26-390. Soluble CD4 can be obtained commercially (e.g., from Mybiosource); methods of its production are well known in the art.

Conservative variants: "Conservative" amino acid substitutions are those substitutions that do not substantially affect or decrease a function of a protein, such as the ability of the protein to induce an immune response when administered to a subject. The term conservative variation also includes the use of a substituted amino acid in place of an unsubstituted parent amino acid. Furthermore, individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

Conservative amino acid substitution tables providing functionally similar amino acids are well known. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Non-conservative substitutions are those that reduce an activity or function of the recombinant Env protein, such as the ability to induce an immune response when administered to a subject. For instance, if an amino acid residue is essential for a function of the protein, even an otherwise conservative substitution may disrupt that activity. Thus, a conservative substitution does not alter the basic function of a protein of interest.

Control: A reference standard. In some embodiments, the control is a negative control sample obtained from a healthy patient. In other embodiments, the control is a positive control sample obtained from a patient diagnosed with HIV-1 infection. In still other embodiments, the control is a historical control or standard reference value or range of values (such as a previously tested control sample, such as a group of HIV-1 patients with known prognosis or outcome, or group of samples that represent baseline or normal values).

A difference between a test sample and a control can be an increase or conversely a decrease. The difference can be a qualitative difference or a quantitative difference, for example, a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

Degenerate variant: In the context of the present disclosure, a "degenerate variant" refers to a polynucleotide encoding a polypeptide (such as a disclosed recombinant gp120 protein) that includes a sequence that is degenerate as a result of the genetic code. There are 20 natural amino acids, most of which are specified by more than one codon. Therefore, all degenerate nucleotide sequences encoding a peptide are included as long as the amino acid sequence of the peptide encoded by the nucleotide sequence is unchanged.

Expression: Transcription or translation of a nucleic acid sequence. For example, a gene is expressed when its DNA is transcribed into an RNA or RNA fragment, which in some examples is processed to become mRNA. A gene may also be expressed when its mRNA is translated into an amino acid sequence, such as a protein or a protein fragment. In a particular example, a heterologous gene is expressed when it is transcribed into an RNA. In another example, a heterologous gene is expressed when its RNA is translated into an amino acid sequence. The term "expression" is used herein to denote either transcription or translation. Regulation of expression can include controls on transcription, translation, RNA transport and processing, degradation of intermediary molecules such as mRNA, or through activation, inactivation, compartmentalization or degradation of specific protein molecules after they are produced.

Expression control sequences: Nucleic acid sequences that regulate the expression of a heterologous nucleic acid sequence to which it is operatively linked. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

A polynucleotide can be inserted into an expression vector that contains a promoter sequence which facilitates the efficient transcription of the inserted genetic sequence of the host. The expression vector typically contains an origin of replication, a promoter, as well as specific nucleic acid sequences that allow phenotypic selection of the transformed cells.

Expression vector: A vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

Glycosylation site: An amino acid sequence on the surface of a polypeptide, such as a protein, which accommodates the attachment of a glycan. An N-linked glycosylation site is triplet sequence of NX(S/T) in which N is asparagine, X is any residues except proline, and (S/T) is a serine or threonine residue. A glycan is a polysaccharide or oligosaccharide. Glycan may also be used to refer to the carbohydrate portion of a glycoconjugate, such as a glycoprotein, glycolipid, or a proteoglycan.

Heterologous: Originating from a different genetic source. A nucleic acid molecule that is heterologous to a cell originated from a genetic source other than the cell in which it is expressed. In one specific, non-limiting example, a heterologous nucleic acid molecule encoding a disclosed recombinant gp120 is expressed in a cell, such as a mammalian cell. Methods for introducing a heterologous nucleic acid molecule in a cell or organism are well known in the art, for example, transformation with a nucleic acid, including electroporation, lipofection, particle gun acceleration, and homologous recombination.

Host cells: Cells in which a vector can be propagated and its DNA expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Human Immunodeficiency Virus Type 1 (HIV-1): A retrovirus that causes immunosuppression in humans (HIV-1 disease), and leads to a disease complex known as the acquired immunodeficiency syndrome (AIDS). "HIV-1 disease" refers to a well-recognized constellation of signs and symptoms (including the development of opportunistic infections) in persons who are infected by an HIV-1 virus, as determined by antibody or western blot studies. Laboratory findings associated with this disease include a progressive decline in T cells. Related viruses that are used as animal models include simian immunodeficiency virus (SIV), and feline immunodeficiency virus (FIV). Treatment of HIV-1 with HAART has been effective in reducing the viral burden and ameliorating the effects of HIV-1 infection in infected individuals.

HIV-1 broadly neutralizing antibody: An antibody that reduces the infectious titer of HIV-1 by binding to HIV-1 Envelope protein and inhibiting HIV-1 function. In some embodiments, broadly neutralizing antibodies to HIV are distinct from other antibodies to HIV in that they neutralize a high percentage (such as at least 50% or at least 80%) of the many types of HIV in circulation. Non-limiting examples of HIV-1 broadly neutralizing antibodies include PGT122, VRC01, and 35022.

HIV-1 envelope protein (Env): The HIV-1 Env protein is initially synthesized as a precursor protein of 845-870 amino acids in size. Individual precursor polypeptides form a homotrimer and undergo glycosylation within the Golgi apparatus as well as processing to remove the signal peptide, and cleavage by a cellular protease between approximately positions 511/512 to generate separate gp120 and gp41 polypeptide chains, which remain associated as gp120-gp41 protomers within the homotrimer. The ectodomain (that is, the extracellular portion) of the HIV-1 Env trimer undergoes several structural rearrangements from a prefusion mature (cleaved) closed conformation that evades antibody recognition, through intermediate conformations that bind to receptors CD4 and co-receptor (either CCR5 or CXCR4), to a postfusion conformation. The HIV-1 Env ectodomain comprises the gp120 (approximately HIV-1 Env positions 31-511) and the gp41 ectodomain (approximately HIV-1 Env positions 512-644). An HIV-1 Env ectodomain trimer comprises a protein complex of three HIV-1 Env ectodomains. As used herein "HIV-1 Env ectodomain trimer" includes both soluble trimers (that is, trimers without gp41 transmembrane domain or cytoplasmic tail) and membrane anchored trimers (for example, trimers including a full-length gp41).

Mature gp120 includes approximated HIV-1 Env residues 31-511, contains most of the external, surface-exposed, domains of the HIV-1 Env trimer, and it is gp120 which binds both to cellular CD4 receptors and to cellular chemokine receptors (such as CCR5). A mature gp120 polypeptide is an extracellular polypeptide that interacts with the gp41 ectodomain to form an HIV-1 Env protomer that trimerizes to form the HIV-1 Env ectodomain trimer. The mature gp120 wild-type polypeptide is heavily N-glycosylated, giving rise to an apparent molecular weight of 120 kD. Native gp120 includes five conserved regions (C1-C5) and five regions of high variability (V1-V5). See FIG. 11 for an illustration of gp120 primary and secondary structures.

Mature gp41 includes approximately HIV-1 Env residues 512-860, and includes cytosolic-, transmembrane-, and ectodomains. The gp41 ectodomain (including approximately HIV-1 Env residues 512-644) can interact with gp120 to form an HIV-1 Env protomer that trimerizes to form the HIV-1 Env trimer.

The prefusion mature closed conformation of the HIV-1 Env ectodomain trimer is a structural conformation adopted by HIV-1 Env ectodomain trimer after cellular processing to a mature prefusion state with distinct gp120 and gp41 polypeptide chains, and before specific binding to the CD4 receptor. The three-dimensional structure of an exemplary HIV-1 Env ectodomain trimer in the prefusion mature closed conformation is known (see, e.g., Pancera et al., Nature, 514:455-461, 2014). In the prefusion mature closed conformation, the HIV-1 Env ectodomain trimer includes a V1V2 domain "cap" at its membrane distal apex, with the V1V2 domain of each Env protomer in the trimer coming together at the membrane distal apex. At the membrane proximal aspect, the prefusion mature closed conformation of the HIV-1 Env ectodomain trimer includes distinct α6 and α7 helices. CD4 binding causes changes in the conformation of the HIV-1 Env ectodomain trimer, including disruption of the V1V1 domain cap, which "opens" as each V1V2 domain moves outward from the longitudinal axis of the Env trimer, and formation of the HR1 helix, which includes both the α6 and α7 helices (which are no longer distinct). These conformational changes bring the N-terminus of the fusion peptide within close proximity of the target cell membrane, and expose "CD4-induced" epitopes (such as the 17b epitope) that are present in the CD4-bound open conformation, but not the mature closed conformation, of the HIV-1 Env ectodomain trimer.

The numbering used in the disclosed HIV-1 Env proteins and fragments thereof (such as a gp120 and gp41) is relative to the HXB2 numbering scheme as set forth in *Numbering Positions in HIV Relative to HXB2CG* Bette Korber et al., Human Retroviruses and AIDS 1998: A Compilation and Analysis of Nucleic Acid and Amino Acid Sequences. Korber et al., Eds. Theoretical Biology and Biophysics Group, Los Alamos National Laboratory, Los Alamos, N. Mex., which is incorporated by reference herein in its entirety. In one example, an HIV-1 Env protein is from the BG505 strain of HIV, which is a Clade A HIV-1 virus isolated from a six-week old HIV-1 infected infant. The amino acid sequence of BG505 Env protein is known (see, e.g., GenBank accession no. ABA61516, incorporated by reference herein as present in the database on Jun. 20, 2014), and set forth as SEQ ID NO: 2.

HIV-1 Env ectodomain trimer stabilized in a prefusion mature closed conformation: A HIV-1 Env ectodomain trimer having one or more amino acid substitutions, deletions, or insertions compared to a native HIV-1 Env sequence that provide for increased retention of the prefusion mature closed conformation upon CD4 binding compared to a corresponding native HIV-1 Env sequence. In some embodiments, the HIV-1 Env ectodomain trimer can include one or more cysteine substitutions that allow formation of a non-natural disulfide bond that stabilizes the HIV-1 Env ectodomain trimer in its prefusion mature closed conformation.

A HIV-1 Env ectodomain trimer stabilized in the prefusion mature closed conformation has at least 90% (such as at least 95% or at least 99%) reduced transition to the CD4-bound open conformation upon CD4 binding compared to a corresponding native HIV-1 Env sequence. The "stabilization" of the prefusion mature closed conformation by the one or more amino acid substitutions, deletions, or insertions can be, for example, energetic stabilization (for example, reducing the energy of the prefusion mature closed conformation relative to the CD4-bound open conformation) and/or kinetic stabilization (for example, reducing the rate of transition from the prefusion mature closed conformation to the prefusion mature closed conformation). Additionally, stabilization of the HIV-1 Env ectodomain trimer in the prefusion mature closed conformation can include an increase in resistance to denaturation compared to a corresponding native HIV-1 Env sequence.

Methods of determining if a HIV-1 Env ectodomain trimer is in the prefusion mature closed conformation are provided herein, and include (but are not limited to) negative stain electron microscopy and antibody binding assays using a prefusion mature closed conformation specific antibody, such as VRC26 or PGT145. Methods of determining if a HIV-1 Env ectodomain trimer is in the CD4-bound open conformation are also provided herein, and include (but are not limited to) negative stain electron microscopy and antibody binding assays using a CD4-bound open conformation specific antibody, such as 17b, which binds to a CD4-induced epitope. Transition from the prefusion mature closed conformation upon CD4 binding can be assayed, for example, by incubating a HIV-1 Env ectodomain trimer of interest that is in the prefusion mature closed conformation with a molar excess of CD4, and determining if the HIV-1 Env ectodomain trimer retains the prefusion mature closed conformation (or transitions to the CD4-bound open conformation) by negative stain electron microscopy analysis, or antigenic analysis.

HIV-1 gp140: A recombinant HIV Env polypeptide including gp120 and the gp41 ectodomain, but not the gp41 transmembrane or cytosolic domains. HIV-1 gp140 polypeptides can trimerize to form a soluble HIV-1 Env ectodomain trimer.

HIV-1 gp145: A recombinant HIV Env polypeptide including gp120, the gp41 ectodomain, and the gp41 transmembrane domain. HIV-1 gp145 polypeptides can trimerize to form a membrane-anchored HIV-1 Env ectodomain trimers.

HIV-1 gp160: A recombinant HIV Env polypeptide including gp120 and the entire gp41 protein (ectodomain, transmembrane domain, and cytosolic tail).

HXB2 numbering system: A reference numbering system for HIV protein and nucleic acid sequences, using the HIV-1 HXB2 strain sequences as a reference for all other HIV-1 strain sequences. The HXB2 numbering system is set forth in "Numbering Positions in HIV Relative to HXB2CG," Bette Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex., which is incorporated by reference herein in its entirety. Unless context indicates otherwise, the numbering used in HIV-1 polypeptides disclosed herein is relative to the HXB2 numbering scheme. For reference, the amino acid sequence of HIV-1 Env of HXB2 is set forth as SEQ ID NO: 1 (GENBANK® Accession No. K03455, incorporated by reference herein as present in the database on Jun. 20, 2014).

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies. "Priming an immune response" refers to pre-treatment of a subject with an adjuvant to increase the desired immune response to a later administered immunogenic agent. "Enhancing an immune response" refers to co-administration of an adjuvant and an immunogenic agent, wherein the adjuvant increases the desired immune response to the immunogenic agent compared to administration of the immunogenic agent to the subject in the absence of the adjuvant.

Immunogen: A protein or a portion thereof that is capable of inducing an immune response in a mammal, such as a mammal infected or at risk of infection with a pathogen. Administration of an immunogen can lead to protective immunity and/or proactive immunity against a pathogen of interest. In some examples, an immunogen comprises a recombinant HIV-1 Env ectodomain trimer as disclosed herein.

Immunogenic composition: A composition comprising a disclosed immunogen, or a nucleic acid molecule or vector encoding a disclosed immunogen, that induces a measurable CTL response against the immunogen, or induces a measurable B cell response (such as production of antibodies) against the immunogen, when administered to a subject. In one example, an immunogenic composition is a pharmaceutical composition that includes a disclosed recombinant HIV-1 Env ectodomain trimer or immunogenic fragment thereof, that induces a measurable CTL response against HIV-1, or induces a measurable B cell response (such as production of antibodies) against a HIV-1. It further refers to isolated nucleic acids encoding an immunogen, such as a nucleic acid that can be used to express the immunogen (and thus be used to elicit an immune response against this immunogen). For in vivo use, the immunogenic composition will typically include the protein or nucleic acid molecule in a pharmaceutically acceptable carrier and may also include other agents, such as an adjuvant.

Isolated: An "isolated" biological component has been substantially separated or purified away from other biological components, such as other biological components in which the component naturally occurs, such as other chromosomal and extrachromosomal DNA, RNA, and proteins. Proteins, peptides, nucleic acids, and viruses that have been "isolated" include those purified by standard purification methods. Isolated does not require absolute purity, and can include protein, peptide, nucleic acid, or virus molecules that are at least 50% isolated, such as at least 75%, 80%, 90%, 95%, 98%, 99%, or even 99.9% isolated.

Linker and Linked: A bi-functional molecule that can be used to link two molecules into one contiguous molecule. Non-limiting examples of peptide linkers include glycine-serine peptide linkers. Unless context indicates otherwise, reference to "linking" a first polypeptide and a second polypeptide (or to two polypeptides "linked" together) refers to covalent linkage by peptide bond, or (if a peptide linker is involved) covalent linkage of the first and second polypeptides to the N and C termini of a peptide linker. Thus, reference to a gp120 polypeptide "linked" to a gp41 ectodomain by a peptide linker indicates that the gp120 polypeptide and the gp41 ectodomain are linked to opposite ends of the peptide linker by peptide bonds. Typically, such linkage is accomplished using molecular biology techniques to genetically manipulate DNA encoding the first polypeptide linked to the second polypeptide by the peptide linker.

Native protein, sequence, or disulfide bond: A polypeptide, sequence or disulfide bond that has not been modified, for example, by selective mutation. For example, selective mutation to focus the antigenicity of the antigen to a target epitope, or to introduce a disulfide bond into a protein that does not occur in the native protein. Native protein or native sequence are also referred to as wild-type protein or wild-type sequence. A non-native disulfide bond is a disulfide bond that is not present in a native protein, for example, a disulfide bond that forms in a protein due to introduction of one or more cysteine residues into the protein by genetic engineering.

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "nucleic acid" and "polynucleotide." A nucleic acid molecule is usually at least 10 bases in length, unless otherwise specified. The term includes single- and double-stranded forms of DNA. A polynucleotide may include either or both naturally occurring and modified nucleotides linked together by naturally occurring and/or non-naturally occurring nucleotide linkages. "cDNA" refers to a DNA that is complementary or identical to an mRNA, in either single stranded or double stranded form. "Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked nucleic acid sequences are contiguous and, where necessary to join two protein-coding regions, in the same reading frame.

Pharmaceutically acceptable carriers: The pharmaceutically acceptable carriers of use are conventional. Remington's Pharmaceutical Sciences, by E. W. Martin, Mack Publishing Co., Easton, Pa., 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example, sodium acetate or sorbitan monolaurate. In particular embodiments, suitable for administration to a subject the carrier may be sterile, and/or suspended or otherwise contained in a unit dosage form containing one or more measured doses of the composition suitable to induce the desired anti-HIV-1 immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Polypeptide: Any chain of amino acids, regardless of length or post-translational modification (e.g., glycosylation or phosphorylation). "Polypeptide" applies to amino acid polymers including naturally occurring amino acid polymers and non-naturally occurring amino acid polymer as well as in which one or more amino acid residue is a non-natural amino acid, for example, an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used herein to refer to a polymer of amino acid residues.

Polypeptide modifications: Polypeptides and peptides, such as the recombinant HIV-1 Env proteins disclosed herein can be modified by a variety of chemical techniques to produce derivatives having essentially the same activity as the unmodified peptides, and optionally having other desirable properties. For example, carboxylic acid groups of the protein, whether carboxyl-terminal or side chain, may be provided in the form of a salt of a pharmaceutically-acceptable cation or esterified to form a $C_1$-$C_{16}$ ester, or converted to an amide of formula $NR_1R_2$ wherein $R_1$ and $R_2$ are each independently H or $C_1$-$C_{16}$ alkyl, or combined to form a heterocyclic ring, such as a 5- or 6-membered ring. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be modified to $C_1$-$C_{16}$ alkyl or dialkyl amino or further converted to an amide.

Prime-boost vaccination: An immunotherapy including administration of a first immunogenic composition (the primer vaccine) followed by administration of a second immunogenic composition (the booster vaccine) to a subject to induce an immune response. The primer vaccine and/or the booster vaccine include a vector (such as a viral vector, RNA, or DNA vector) expressing the antigen to which the immune response is directed. The booster vaccine is administered to the subject after the primer vaccine; exemplary time interval between administration of the primer vaccine and the booster vaccine are known, and examples of such timeframes are disclosed herein. In some embodiments, the primer vaccine, the booster vaccine, or both primer vaccine and the booster vaccine additionally include an adjuvant. In one non-limiting example, the primer vaccine is a DNA-based vaccine (or other vaccine based on gene delivery), and the booster vaccine is a protein subunit or protein nanoparticle based vaccine.

Recombinant: A recombinant nucleic acid is one that has a sequence that is not naturally occurring or has a sequence that is made by an artificial combination of two otherwise separated segments of sequence. This artificial combination can be accomplished, for example, the artificial manipulation of isolated segments of nucleic acids, for example, using genetic engineering techniques. A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell. The nucleic acid can be introduced, for example, on an expression vector having signals capable of expressing the protein encoded by the introduced nucleic acid or the nucleic acid can be integrated into the host cell chromosome.

Sample (or biological sample): A biological specimen containing genomic DNA, RNA (including mRNA), protein, or combinations thereof, obtained from a subject. Examples include, but are not limited to, peripheral blood, tissue, cells, urine, saliva, tissue biopsy, fine needle aspirate, surgical specimen, and autopsy material.

Sequence identity: The identity between two or more nucleic acid sequences, or two or more amino acid sequences, is expressed in terms of the identity between the sequences. Sequence identity can be measured in terms of percentage identity; the higher the percentage, the more identical the sequences are. Homologs and variants of protein of interest are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of the protein.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci.*

USA 85:2444, 1988; Higgins & Sharp, *Gene*, 73:237-44, 1988; Higgins & Sharp, *CABIOS* 5:151-3, 1989; Corpet et al., *Nuc. Acids Res.* 16:10881-90, 1988; Huang et al. *Computer Appls. in the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations. The NCBI Basic Local Alignment Search Tool (BLAST) (Altschul et al., *J. Mol. Biol.* 215:403-10, 1990) is available from several sources, including the National Center for Biological Information (NCBI, National Library of Medicine, Building 38A, Room 8N805, Bethesda, Md. 20894) and on the Internet, for use in connection with the sequence analysis programs blastp, blastn, blastx, tblastn, and tblastx. Blastn is used to compare nucleic acid sequences, while blastp is used to compare amino acid sequences. Additional information can be found at the NCBI web site.

Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100.

As used herein, reference to "at least 80% identity" (or similar language) refers to "at least 80%, at least 85%, at least 90%, at least 91%, at least 92%, at least 93%, at least 94%, at least 95%, at least 96%, at least 97%, at least 98%, at least 99%, or even 100% identity" to a specified reference sequence. As used herein, reference to "at least 90% identity" (or similar language) refers to "at least 90%, at least 91%, at least 92%, at least 93%, at least 94%, at least 95%, at least 96%, at least 97%, at least 98%, at least 99%, or even 100% identity" to a specified reference sequence.

Signal Peptide: A short amino acid sequence (e.g., approximately 18-25 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region). Exemplary signal peptide sequences are set forth as residues 1-30 of SEQ ID NO: 1 (HXB2 Env signal peptide) and SEQ ID NO: 2 (BG505 Env signal peptide).

Single chain HIV-1 Env ectodomain: A recombinant polypeptide including gp120 and the gp41 ectodomain in a single polypeptide chain. Single chain HIV-1 Env ectodomains can trimerize to form a trimeric HIV-1 Env ectodomain. A single chain HIV-1 Env ectodomain does not include the furin cleavage site separating gp120 and gp41; therefore, when produced in cells, the Env ectodomain is not cleaved into separate gp120 and gp41 ectodomain polypeptides. For example, the gp120 and gp41 proteins can be linked by a peptide linker, or directly linked. Single chain HIV-1 Env ectodomains are of particular interest for DNA or vector encoded immunogens, as it can be beneficial in these immunogen format to not need to rely on the presence of furin (or furin-like) protease in a host cell for maturation of separate gp120/gp41 polypeptides.

Spacer Amino Acid: A "spacer amino acid" is sometimes placed on either side (N- or C-terminal) or on both sides (N- and C-terminal) immediately adjacent to an inserted or substituted amino acid to modify the tertiary positioning of the inserted or substituted amino acid in a protein. Typical spacer amino acids include glycine, serine, alanine, threonine, or proline. In several embodiments, two spacer amino acid can be sued, such as glycine-glycine, serine-serine, glycine-serine, or serine-glycine.

Specifically bind: When referring to the formation of an antibody:antigen protein complex, or a protein:protein complex, refers to a binding reaction which determines the presence of a target protein, peptide, or polysaccharide (for example, a glycoprotein), in the presence of a heterogeneous population of proteins and other biologics. Thus, under designated conditions, a particular antibody or protein binds preferentially to a particular target protein, peptide or polysaccharide (such as an antigen present on the surface of a pathogen, for example, gp120) and does not bind in a significant amount to other proteins or polysaccharides present in the sample or subject. Specific binding can be determined by methods known in the art. A first protein or antibody specifically binds to a target protein when the interaction has a $K_D$ of less than $10^{-6}$ Molar, such as less than $10^{-7}$ Molar, less than $10^{-8}$ Molar, less than $10^{-9}$, or even less than $10^{-10}$ Molar.

Subject: Living multi-cellular vertebrate organisms, a category that includes human and non-human mammals. In an example, a subject is a human. In a particular example, the subject is a newborn infant. In an additional example, a subject is selected that is in need of inhibiting of an HIV-1 infection. For example, the subject is either uninfected and at risk of HIV-1 infection or is infected in need of treatment.

Therapeutically effective amount: A quantity of a specified agent, such as a disclosed immunogen or immunogenic composition, that is sufficient to induce an immune response in a subject to prevent, treat (including prophylaxis), reduce and/or ameliorate the symptoms and/or underlying causes of a disorder or disease, for example, to prevent, inhibit, and/or treat HIV-1 infection. In some embodiments, a therapeutically effective amount induces an immune response that is sufficient to reduce or eliminate a symptom of a disease, such as HIV-1 infection. For instance, this can be the amount necessary to inhibit or prevent viral replication or to measurably alter outward symptoms of the viral infection. In general, this amount will be sufficient to measurably inhibit virus replication or infectivity.

In one example, a desired response is to inhibit or reduce or prevent HIV-1 infection. The HIV-1 infected cells do not need to be completely eliminated or reduced or prevented for the composition to be effective. For example, administration of a therapeutically effective amount of the agent can decrease the number of HIV-1 infected cells (or prevent the infection of cells) by a desired amount, for example, by at least 50%, at least 60%, at least 70%, at least 80%, at least 90%, at least 95%, at least 98%, or even at least 100% (elimination or prevention of detectable HIV-1 infected cells), as compared to the number of HIV-1 infected cells in the absence of the composition.

It is understood that to obtain a protective immune response against a pathogen can require multiple administrations of the immunogenic composition. Thus, a therapeutically effective amount encompasses a fractional dose that contributes in combination with previous or subsequent administrations to attaining a protective immune response. For example, a therapeutically effective amount of an agent can be administered in a single dose, or in several doses, for example, daily, during a course of treatment (such as a prime-boost vaccination treatment). However, the therapeutically effective amount can depend on the subject being treated, the severity and type of the condition being treated, and the manner of administration. A unit dosage form of the agent can be packaged in a therapeutic amount, or in multiples of the therapeutic amount, for example, in a vial (e.g., with a pierceable lid) or syringe having sterile components.

Transmembrane domain: An amino acid sequence that inserts into a lipid bilayer, such as the lipid bilayer of a cell or virus or virus-like particle. A transmembrane domain can be used to anchor an antigen to a membrane. In some examples a transmembrane domain is a HIV-1 Env transmembrane domain. Exemplary HIV-1 Env transmembrane domains are provided herein, for example, as SEQ ID NO: 18.

Treating or inhibiting HIV-1: Inhibiting the full development of HIV-1 in a subject who is at risk for or has an HIV-1 infection or acquired immunodeficiency syndrome (AIDS). "Treatment" refers to a therapeutic intervention that ameliorates a sign or symptom of HIV-1 infection in an infected subject. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

Inhibiting HIV-1 in an uninfected subject refers to a reduction in infection rate or likelihood of infection. In this context, the term "reduces" is a relative term. An immunogenic composition that induces an immune response that inhibits HIV-1, can, but does not necessarily completely, inhibit HIV-1 infection of a subject (or group of subjects), so long as the infection is measurably diminished, for example, by at least about 50%, such as by at least about 70%, or about 80%, or even by about 90% of (that is to 10% or less than) the infection or response in the absence of the agent, or in comparison to a reference agent.

Tyrosine Sulfation: Addition of a sulfate group to a tyrosine residue in a protein. In cells, tyrosine sulfation is a post translational modification where a sulfate group is added to a tyrosine residue of a protein molecule in the Golgi or endoplasmic reticulum. Tyrosine sulfation can be catalyzed by a tyrosyl-protein sulfotransferase (TPST), such as TPST1 or TPST2. The reaction catalyzed by TPST is a transfer of sulfate from the universal sulfate donor 3'-phosphoadenosine-5'-phosphosulfate (PAPS) to the side-chain hydroxyl group of a tyrosine residue. Tyrosine sulfation can also be accomplished in vitro, for example, by incubating a peptide containing one or more tyrosine residues with a TBST enzyme (such as TBST1 or TBST2) under appropriate conditions. Methods of sulfating a tyrosine residue on a protein are known (see, e.g., U.S. Pat. No. 5,541,095, U.S. Pub. Nos. 2009/0042738, 2006/0009631, 2003/0170849, 2006/0115859, Liu et al., Mol. Biosyst., 7:38-47, 2011, and Choe and Farzan, Methods in Enzymology, 461: 147-170, 2009) each of which is incorporated by reference herein). Any of the disclosed recombinant gp120 proteins, or an HIV-1 Env ectodomain trimer including the recombinant gp120 protein can be produced by expression in a host cell that also expresses (e.g., over expresses) TPST.

Under conditions sufficient for: A phrase that is used to describe any environment that permits a desired activity.

Vaccine: A pharmaceutical composition that elicits a prophylactic or therapeutic immune response in a subject. In some cases, the immune response is a protective immune response. Typically, a vaccine elicits an antigen-specific immune response to an antigen of a pathogen, for example a viral pathogen, or to a cellular constituent correlated with a pathological condition. A vaccine may include a polynucleotide (such as a nucleic acid encoding a disclosed antigen), a peptide or polypeptide (such as a disclosed antigen), a virus, a cell or one or more cellular constituents. In one specific, non-limiting example, a vaccine reduces the severity of the symptoms associated with HIV infection and/or decreases the viral load compared to a control. In another non-limiting example, a vaccine reduces HIV-1 infection compared to a control.

Vector: An entity containing a DNA or RNA molecule bearing a promoter(s) that is operationally linked to the coding sequence of an immunogenic protein of interest and can express the coding sequence. Non-limiting examples include a naked or packaged (lipid and/or protein) DNA, a naked or packaged RNA, a subcomponent of a virus or bacterium or other microorganism that may be replication-incompetent, or a virus or bacterium or other microorganism that may be replication-competent. A vector is sometimes referred to as a construct. Recombinant DNA vectors are vectors having recombinant DNA. A vector can include nucleic acid sequences that permit it to replicate in a host cell, such as an origin of replication. A vector can also include one or more selectable marker genes and other genetic elements known in the art. Viral vectors are recombinant nucleic acid vectors having at least some nucleic acid sequences derived from one or more viruses.

A non-limiting example of a DNA-based expression vector is pCDNA3.1, which can include includes a mammalian expression enhancer and promoter (such as a CMV promoter). Non-limiting examples of viral vectors include adeno-associated virus (AAV) vectors as well as Poxvirus vector (e.g., Vaccinia, MVA, avian Pox, or Adenovirus).

Virus-like particle (VLP): A non-replicating, viral shell, derived from any of several viruses. VLPs are generally composed of one or more viral proteins, such as, but not limited to, those proteins referred to as capsid, coat, shell, surface and/or envelope proteins, or particle-forming polypeptides derived from these proteins. VLPs can form spontaneously upon recombinant expression of the protein in an appropriate expression system. Methods for producing particular VLPs are known in the art. The presence of VLPs following recombinant expression of viral proteins can be detected using conventional techniques known in the art, such as by electron microscopy, biophysical characterization, and the like. Further, VLPs can be isolated by known techniques, e.g., density gradient centrifugation and identified by characteristic density banding. See, for example, Baker et al. (1991) *Biophys. J.* 60:1445-1456; and Hagensee et al. (1994) *J. Virol.* 68:4503-4505; Vincente, *J Invertebr Pathol.*, 2011; Schneider-Ohrum and Ross, *Curr. Top. Microbiol. Immunol.,* 354: 53073, 2012).

II. Immunogens

A. Recombinant gp120 and HIV-1 Env ectodomain Trimers

Isolated immunogens are disclosed herein that include a recombinant HIV-1 Env ectodomain trimer that is modified from a native form (e.g., by introduction of one or more amino acid substitutions) to be stabilized in a conformation that does not bind to CD4, but does bind to broadly neutralizing antibodies, such as PG9, PG16, VRC26, PGT145, VRC01, VRC07, N6, 35022, 8ANC195, PGT151, and/or PGT121. In several embodiments, the recombinant HIV-1 Env ectodomain trimer is stabilized in the prefusion mature closed conformation of HIV-1 Env. Additionally, gp120 proteins, gp140 proteins, gp145 proteins, and gp160 proteins are provided that include the disclosed modifications to be stabilized in the conformation that does not bind to CD4, but does bind to broadly neutralizing antibodies, such as the prefusion mature closed conformation.

Figure 9:
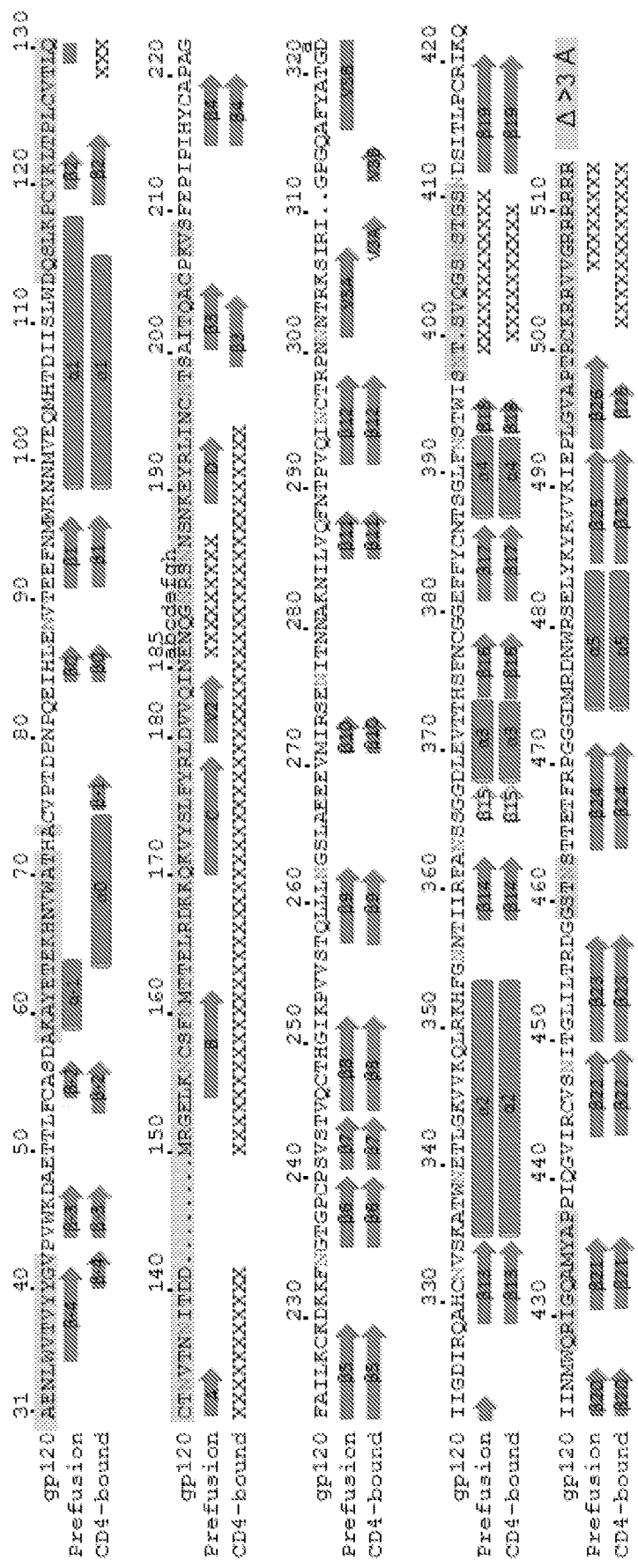

In some embodiments, the recombinant HIV-1 Env ectodomain trimer comprises a recombinant gp120 protein that comprises a first non-natural disulfide bond between a cysteine residue in an α1 helix of the gp120 protein and a cysteine residue in a β20-β21 region of the gp120 protein. Unless context indicates otherwise, reference herein to gp120 secondary structure refers to the secondary structure of gp120 protein in its prefusion mature closed conformation as illustrated in FIG. 9. The presence of the first non-natural disulfide bond stabilizes the gp120 protein (and the corresponding HIV-1 Env ectodomain trimer) in a conformation that does not specifically bind to CD4, but retains binding to broadly neutralizing antibodies, such as the prefusion mature closed conformation. The cysteine residues of the non-natural disulfide bond can be introduced by amino acid substitution and/or insertion. In several embodiments, the cysteine substitution in the α1 helix is at one of HIV-1 Env positions 106-118 (such as HIV-1 Env positions 108-115) and the cysteine substitution or insertion in the β20-β21 region is at one of (or between two of) HIV-1 Env positions 423-435 (such as HIV-1 Env positions 427-432). Unless context indicates otherwise, the HIV-1 Env positions used herein correspond to a HIV-1 Env HXB2 reference sequence set forth as SEQ ID NO: 1.

In some embodiments, the first non-natural disulfide bond between the α1 helix and the β20-β21 region can be between a cysteine substitution at HIV-1 Env position 113 (such as a D113C substitution) of the α1 helix, and a cysteine substitution or insertion at one of HIV-1 Env positions 428-432 of the β20-β21 region, such as a cysteine substitution or insertion at one of HIV-1 Env positions 429 or 432.

In some embodiments, the first non-natural disulfide bond between the α1 helix and the β20-β21 region can be between a cysteine substitution at HIV-1 Env position 113 (such as a D113C substitution) of the α1 helix, and a cysteine substitution at HIV-1 Env position 429 of the β20-β21 region. In several embodiments one or two spacer amino acids (such as a glycine or glycine-serine, or serine-glycine) can be inserted on either side (N- and C-terminal) of the cysteine residue at position 429. The presence of the spacer amino acid can facilitate formation of the non-natural disulfide bond between the 113C and 429C substitutions. Exemplary amino acids that can be inserted on either side of the 429C cysteine residue include glycine, serine, alanine, threonine, and proline. In several embodiments, a glycine residue is inserted on either side of the 429C substitution to facilitate formation of the 113C-429C non-natural disulfide bond. In several embodiments, the first non-natural disulfide bond between the α1 helix and the β20-β21 region can be between a cysteine introduced by a D113C substitution in the α1 helix, and a cysteine introduced by one of a R429GCG substitution, a E429GCGsubstitution, a G429GCG substitution, or a K429GCG substitution in the β20-β21 region (the substituted amino acid varies depending on the strain and Clade of the parent HIV-1 virus).

In some embodiments, the first non-natural disulfide bond between the α1 helix and the β20-β21 region can be between a cysteine substitution at HIV-1 Env position 113 (such as a D113C substitution) of the α1 helix, and a cysteine insertion between HIV-1 Env positions 431 and 432 of the β20-β21 region. In several embodiments one or two spacer amino acids (such as a glycine or glycine-serine, or serine-glycine) can be inserted C-terminal to the inserted cysteine, that is, the spacer amino acid can be inserted between the inserted cysteine and position 432. The presence of the spacer amino acid can facilitate formation of the non-natural disulfide bond between the 113C and the cysteine inserted between 431/432. Exemplary amino acids that can be inserted on the C-terminal side of the cysteine inserted between 431/432 include glycine, serine, alanine, threonine, and proline. In several embodiments, a glycine residue is inserted on the C-terminal side of the cysteine inserted between 431/432 to facilitate formation of the non-natural disulfide bond. In several embodiments, the first non-natural disulfide bond between the α1 helix and the β20-β21 region can be between a cysteine introduced by a D113C substitution in the α1 helix, and a cysteine introduced by a G431GCG substitution in the β20-β21 region.

In some embodiments, the first non-natural disulfide bond between the α1 helix and the β20-β21 region can be between a cysteine substitution at HIV-1 Env position 113 (such as a D113C substitution) of the α1 helix, and a cysteine substitution at HIV-1 Env position 432 of the β20-β21 region. In several embodiments one or two spacer amino acids (such as a glycine or glycine-serine, or serine-glycine) can be inserted on either side (N- and C-terminal) of the cysteine residue at position 432. The presence of the spacer amino acid can facilitate formation of the non-natural disulfide bond between the 113C and 432C substitutions. Exemplary amino acids that can be inserted on either side of the 432C cysteine residue include glycine, serine, alanine, threonine, and proline. In several embodiments, a glycine residue is inserted on either side of the 432C substitution to facilitate formation of the 113C-432C non-natural disulfide bond. In several embodiments, the first non-natural disulfide bond between the α1 helix and the β20-β21 region can be between a cysteine introduced by a D113C substitution in the α1 helix, and a cysteine introduced by one of a Q432GCG substitution, a R432GCG substitution, or a K432GCG substitution in the β20-β21 region (the substituted amino acid varies depending on the strain and Clade of the parent HIV-1 virus).

In some embodiments, the first non-natural disulfide bond between the α1 helix and the β20-β21 region can be between a cysteine substitution at HIV-1 Env position 116 (such as a L116C substitution) of the α1 helix, and a cysteine insertion between HIV-1 Env positions 431 and 432 or HIV-1 Env positions 432 and 433 of the β20-β21 region. In several embodiments one or two spacer amino acids (such as a glycine or glycine-serine, or serine-glycine) can be inserted immediately N- and/or C-terminal to the inserted cysteine. The presence of the spacer amino acid can facilitate formation of the non-natural disulfide bond between the 116C and the cysteine inserted between 431/432 or 432/433. In several embodiments, the first non-natural disulfide bond between the α1 helix and the β20-β21 region can be between a cysteine introduced by a L116C substitution in the α1 helix, and a cysteine introduced by one of a G431GC substitution, a A433CA substitution, a G431GCG substitution, or a A433GCGA substitution in the β20-β21 region.

In some embodiments, the first non-natural disulfide bond between the α1 helix and the β20-β21 region can be between a cysteine substitution at HIV-1 Env position 117 (such as a K117C substitution) of the α1 helix, and a cysteine insertion between HIV-1 Env positions 431 and 432 or HIV-1 Env positions 432 and 433 of the β20-β21 region. In several embodiments one or two spacer amino acids (such as a glycine or glycine-serine, or serine-glycine) can be inserted immediately N- and/or C-terminal to the inserted cysteine. The presence of the spacer amino acid can facilitate formation of the non-natural disulfide bond between the 117C and the cysteine inserted between 431/432 or 432/433. In several embodiments, the first non-natural disulfide bond between the α1 helix and the β20-β21 region can be between a cysteine introduced by a L117C substitution in the α1 helix, and a cysteine introduced by one of a G431GC substitution, a A433CA substitution, a G431GCG substitution, or a A433GCGA substitution in the β20-β21 region.

In some embodiments, the first non-natural disulfide bond between the α1 helix and the β20-β21 region can be between a cysteine substitution at HIV-1 Env position 108 (such as an I108C substitution) or at HIV-1 Env position 109 (such as an I109C substitution) of the α1 helix, and a cysteine substitution at HIV-1 Env position 427 (such as a W427C substitution) of the β20-β21 region. In several embodiments one or two spacer amino acids (such as a glycine or glycine-serine, or serine-glycine) can be inserted immediately N- and/or C-terminal to the cysteine substitution at position 427. The presence of the spacer amino acid can facilitate formation of the non-natural disulfide bond between the 117C and 427C substitutions. In several embodiments, the first non-natural disulfide bond between the α1 helix and the β20-β21 region can be between a cysteines introduced by I108C and W427C substitutions, I108C and W427GCG substitutions; I109C and W427C substitutions, or I109C and W427GCG substitutions.

In some embodiments, the first non-natural disulfide bond between the α1 helix and the β20-β21 region can be between a cysteine substitution at HIV-1 Env position 108 (such as a I108C substitution) of the α1 helix, and a cysteine substitution at HIV-1 Env position 432 of the β20-β21 region. In several embodiments one or two spacer amino acids (such as a glycine or glycine-serine, or serine-glycine) can be inserted on either side (N- and C-terminal) of the cysteine residue at position 432. The presence of the spacer amino acid can facilitate formation of the non-natural disulfide bond between the 108C and 432C substitutions. Exemplary amino acids that can be inserted on either side of the 432C cysteine residue include glycine, serine, alanine, threonine, and proline. In several embodiments, a glycine residue is inserted on either side of the 432C substitution to facilitate formation of the 108C-432C non-natural disulfide bond. In several embodiments, the first non-natural disulfide bond between the α1 helix and the β20-β21 region can be between a cysteine introduced by a D108C substitution in the α1 helix, and a cysteine introduced by one of a Q432C substitution, a R432C substitution, a K432C substitution, a Q432GCG substitution, a R432GCG substitution, or a K432GCG substitution in the β20-β21 region (the substituted amino acid varies depending on the strain and Clade of the parent HIV-1 virus).

In some embodiments, the first non-natural disulfide bond between the α1 helix and the β20-β21 region can be between a cysteine substitution at HIV-1 Env position 109 (such as a I109C substitution) of the α1 helix, and a cysteine substitution at HIV-1 Env position 432 of the β20-β21 region. In several embodiments one or two spacer amino acids (such as a glycine or glycine-serine, or serine-glycine) can be inserted on either side (N- and C-terminal) of the cysteine residue at position 432. The presence of the spacer amino acid can facilitate formation of the non-natural disulfide bond between the 109C and 432C substitutions. Exemplary amino acids that can be inserted on either side of the 432C cysteine residue include glycine, serine, alanine, threonine, and proline. In several embodiments, a glycine residue is inserted on either side of the 432C substitution to facilitate formation of the 109C-432C non-natural disulfide bond. In several embodiments, the first non-natural disulfide bond between the α1 helix and the β20-β21 region can be between a cysteine introduced by a D109C substitution in the α1 helix, and a cysteine introduced by one of a Q432C substitution, a R432C substitution, a K432C substitution, a Q432GCG substitution, a R432GCG substitution, or a K432GCG substitution in the β20-β21 region (the substituted amino acid varies depending on the strain and Clade of the parent HIV-1 virus).

In some embodiments, the recombinant HIV-1 Env ectodomain trimer comprises a recombinant gp120 protein that comprises a second non-natural disulfide bond between a cysteine residue in an al helix of the gp120 protein and a cysteine residue in an α5 helix of the gp120 protein. The presence of the second non-natural disulfide bond stabilizes the gp120 protein in a conformation that does not specifically bind to CD4, but retains binding to broadly neutralizing antibodies, such as the prefusion mature closed conformation. The cysteine residues of the second non-natural disulfide bond can be introduced by amino acid substitution and/or insertion. In several embodiments, the second non-natural disulfide bond is between cysteines introduced by cysteine substitution in the α1 helix at one of HIV-1 Env positions 99-105 (such as HIV-1 Env positions 110-115) and cysteine substitution in the α5 helix at one of HIV-1 Env positions 423-435 (such as HIV-1 Env positions 474-483).

In some embodiments, the second non-natural disulfide bond between the α1 helix and the α5 helix region can be between a cysteine substitution at one of HIV-1 Env positions 101-102 of the α1 helix, and a cysteine substitution at one of HIV-1 Env positions 475-476 of the α5 helix. In some embodiments, the second non-natural disulfide bond between the α1 helix and the α5 helix region can be between a cysteine substitution at HIV-1 Env position 105 (such as a H105C substitution) of the α1 helix, and a cysteine substitution at HIV-1 Env position 483 of the α5 helix (such as a L483C substitution). In several embodiments one or two spacer amino acids can be inserted on either side (immediately N- or C-terminal) or on both sides (immediately N- and C-terminal) of the cysteine substitution at position 101, 102, 105, 475, 476, or 483. The presence of the spacer amino acid can facilitate formation of the second non-natural disulfide bond. In several embodiments, the second non-natural disulfide bond between the α1 helix and the α5 helix can be between a cysteine residues introduced by V101C and L483C substitutions, A101C and L483C substitutions, E102C and R476C substitutions, E102C and K476C substitutions, D102C and R476C substitutions, D102C and K476C substitutions, H105C and M475C substitutions, or Q105C and M475C substitutions (the substituted amino acid varies depending on the strain and Clade of the parent HIV-1 virus).

In some embodiments, the recombinant gp120 protein in the recombinant HIV-1 Env ectodomain trimer can comprise the first non-natural disulfide bond, the second non-natural disulfide bond, or both the first and second non-natural disulfide bonds. Additional mutations that contribute to stabilization of the recombinant HIV-1 Env ectodomain trimer can also be included.

In some embodiments, the recombinant gp120 or HIV-1 Env ectodomain trimer further includes a non-native disulfide bond between cysteine substitutions at one of gp120 positions 68-72 and one of p120 positions 109-113 (HXB2 numbering). For example, the recombinant gp120 can include a non-native disulfide bond between cysteine residues introduced by A70C and L111C substitutions. It is believed that introduction of such a non-native disulfide bond stabilizes the CD4 binding site in a conformation present on the prefusion mature closed form of the HIV-1 Env trimer. In some embodiments, introduction of the non-native disulfide bond can hold a tryptophan residues at gp120 position 69 (HXB2 numbering) inside a cavity occupied by Trp112 and Trp427, to maintain the CD4 binding site in a prefusion mature closed conformation. In some embodiments a recombinant gp120 comprising the non-native disulfide bond between cysteine substitutions at one of gp120 positions 68-72 and one of gp120 positions 109-113 or a HIV-1 Env ectodomain trimer including the recombinant gp120 can produce an enhanced immune response to gp120 compared to a corresponding gp120 or a HIV-1 Env ectodomain trimer that does not include the non-native disulfide bond between cysteine substitutions at one of gp120 positions 68-72 and one of gp120 positions 109-113.

In some embodiments, the recombinant gp120 or a HIV-1 Env ectodomain trimer including the recombinant gp120 further includes a Y61A or a Y61F substitution. It is believed that introduction of the mutation stabilizes the CD4 binding site in a conformation present on the prefusion mature closed form of the HIV-1 Env trimer. In some embodiments, the recombinant gp120 comprising the Y61A or Y61F substitution or a HIV-1 Env ectodomain trimer including the recombinant gp120 produces an enhanced immune response to gp120 compared to a corresponding gp120 or a HIV-1 Env ectodomain trimer that does not include the Y61A or Y61F substitution.

In some embodiments, the recombinant gp120 or the HIV-1 Env ectodomain trimer including the recombinant gp120 further includes one or more amino acid substitutions to remove the N-linked glycan sequon at position N262 and/or N301. It is believed that introduction of such a mutation increases surface exposure of the region of the CD4 binding site when it is in a conformation present on the prefusion mature closed form of the HIV-1 Env trimer, and therefore will increase an immune response to this site. In some embodiments, the recombinant gp120 or the HIV-1 Env ectodomain trimer including the recombinant gp120 can include a N262Q substitution and/or a S264A substitution to remove the N-linked glycan sequon at position N262. In additional embodiments, the recombinant gp120 or the HIV-1 Env ectodomain trimer including the recombinant gp120 can include a N301Q substitution and/or T303A substitution to remove the N-linked glycan sequon at position N301. In some embodiments, a recombinant gp120 comprising the one or more amino acid substitutions to remove the N-linked glycan sequon at position N262 and/or N301 or a HIV-1 Env ectodomain trimer including the recombinant gp120 produces an enhanced immune response to gp120 compared to a corresponding gp120 or a HIV-1 Env ectodomain trimer that does not include the one or more amino acid substitutions to remove the N-linked glycan sequon at position N262 and/or N301.

In some embodiments, the recombinant gp120 protein in any of the disclosed HIV-1 Env ectodomain trimers can further include a non-natural disulfide bond between HIV-1 Env positions 201 and 433. For example, the non-natural disulfide bond can be introduced by including cysteine substitutions at positions 201 and 433 (e.g., I201C and A433C substitutions). The presence of the non-natural disulfide bond between residues 201 and 433 contributes to the stabilization of the HIV-1 Env ectodomain in the prefusion mature closed conformation.

In some embodiments, the HIV-1 Env ectodomain trimer can include gp120-gp41 ectodomain protomers further including the "SOSIP" substitutions, which include a non-natural disulfide bond between cysteine residues introduced at HIV-1 Env positions 501 and 605 (for example, by A501C and T605C substitutions), and a proline residue introduced at HIV-1 Env positions 559 (for example, by an I559P substitution). The presence of the non-natural disulfide bond between positions 501 and 605 and the proline residue at position 559 contributes to the stabilization of the HIV-1 Env ectodomain in the prefusion mature closed conformation. In several embodiments, the recombinant gp120 protein in any of the disclosed any of the recombinant HIV-1 Env ectodomain trimers disclosed herein can further include a non-natural disulfide bond between HIV-1 Env positions 201 and 433 (e.g., by introduction of I201C and A433C substitutions) and the HIV-1 Env ectodomain trimer can further included the SOSIP mutations.

In some embodiments, the recombinant gp120 protein in any of the disclosed HIV-1 Env ectodomain trimers disclosed herein can further include an N-linked glycosylation site at HIV-1 Env position 332 (if not already present on the ectodomain). For example, by T332N substitution in the case of BG505-based immunogens. The presence of the glycosylation site at N332 allows for binding by 2G12 antibody.

In some embodiments, the recombinant gp120 protein in any of the disclosed HIV-1 Env ectodomain trimers disclosed herein can include a lysine residue at HIV-1 Env position 168 (if not already present on the ectodomain). For example, the lysine residue can be added by amino acid substitution (such as an E168K substitution in the case of the JR-FL based immunogens). The presence of the lysine residue at position 168 allows for binding of particular broadly neutralizing antibodies to the V1V2 loop of gp120.

In some embodiments, any of the HIV-1 Env ectodomain trimers including the recombinant gp120 proteins disclosed herein can include mutations to add an N-linked glycan sequon at position 504, position 661, or positions 504 and 661, to increase glycosylation of the membrane proximal region of the ectodomain.

Native HIV-1 Env sequences include a furin cleavage site between positions 508 and 512 (HXB2 numbering), that separates gp120 and gp41. Any of the disclosed recombinant HIV-1 Env ectodomains can further include an enhanced cleavage site between gp120 and gp41 proteins. The enhanced cleavage cite can include, for example, substitution of six arginine resides for the four residues of the native cleavage site (e.g., REKR (SEQ ID NO: 117) to RRRRRR (SEQ ID NO: 118). It will be understood that protease cleavage of the furin or enhanced cleavage site separating gp120 and gp41 can remove a few amino acids from either end of the cleavage site.

The recombinant HIV-1 Env ectodomain trimer includes a protein complex of gp120-gp41 ectodomain protomers. The gp120-gp41 ectodomain protomer can include separate gp120 and gp41 polypeptide chains, or can include gp120 and gp41 polypeptide chains that are linked (e.g., by a peptide linker) to form a single polypeptide chain (e.g., as described in the "single chain" section below). In several embodiments, the recombinant HIV-1 Env ectodomain trimer is membrane anchored and can include a trimeric complex of recombinant HIV-1 Env ectodomains that are linked to a transmembrane domain (e.g., a gp145 protein including a gp120 protein and a gp41 ectodomain and transmembrane domain).

In additional embodiments, a recombinant gp120 protein, a recombinant gp140 protein, a recombinant gp145 protein, and/or a recombinant gp160 protein is provided that comprises the first and/or second non-natural disulfide bond (or additional modifications) as discussed above for stabilization in a conformation that does not specifically bind to CD4, but retains binding to broadly neutralizing antibodies, and/or stabilization in the prefusion mature closed conformation.

In several embodiments, the N-terminal residue of the recombinant gp120 protein included in the HIV-1 Env ectodomain trimer is one of HIV-1 Env positions 1-35, and the C-terminal residue of the recombinant gp120 protein is one of HIV-1 Env positions 503-511. In some embodiments, the N-terminal residue of the recombinant gp120 protein included in the HIV-1 Env ectodomain trimer is HIV-1 Env position 31 and the C-terminal residue of the recombinant gp120 protein is HIV-1 Env position 511 or position 507. In some embodiments, the recombinant gp120 protein included in the HIV-1 Env ectodomain trimer comprises or consists of HIV-1 Env positions 31-507 (HXB2 numbering). In some embodiments, the recombinant gp120 protein included in the HIV-1 Env ectodomain trimer comprises or consists of HIV-1 Env positions 31-507 (HXB2 numbering) of any one of SEQ ID NOs: 22-113, or an amino acid sequence at least 90% identical thereto.

The disclosed HIV-1 Env ectodomain trimer includes the recombinant gp120 protein and a gp41 ectodomain. In the purified trimer, the recombinant gp120 protein typically does not include a signal peptide (for example, the recombinant gp120 protein typically does not include HIV-1 Env positions 1-30), as the signal peptide is proteolytically cleaved during cellular processing. Additionally, in several embodiments, the gp41 ectodomain includes the extracellular portion of gp41 (e.g., positions 512-664). In embodiments including a soluble recombinant HIV-1 Env ectodomain, the gp41 ectodomain is not linked to a transmembrane domain or other membrane anchor. However, in embodiments including a membrane anchored recombinant HIV-1 Env ectodomain trimer the gp41 ectodomain can be linked to a transmembrane domain (such as, but not limited to, an HIV-1 Env transmembrane domain). In several embodiments, the HIV-1 Env ectodomain trimer includes the recombinant gp120 protein and a gp41 ectodomain and the N-terminal residue of the gp120 protein is one of HIV-1 Env positions 1-35;

the C-terminal residue of the gp120 protein is one of HIV-1 Env positions 503-511;

the N-terminal residue of the gp41 ectodomain is one of HIV-1 Env positions 512-522; and/or the C-terminal residue of the gp41 ectodomain is one of HIV-1 Env positions 624-705.

In some embodiments, the HIV-1 Env ectodomain trimer includes the recombinant gp120 protein and the gp41 ectodomain, wherein the N-terminal residue of the recombinant gp120 protein is HIV-1 Env position 31; the C-terminal residue of the recombinant gp120 protein is HIV-1 Env position 507 or 511; the N-terminal residue of the gp41 ectodomain is HIV-1 Env position 512; and the C-terminal residue of the gp41 ectodomain is HIV-1 Env position 664. In some embodiments, the HIV-1 Env ectodomain trimer includes the recombinant gp120 protein and the gp41 ectodomain, wherein the N-terminal residue of the recombinant gp120 protein is HIV-1 Env position 31; the C-terminal residue of the recombinant gp120 protein is HIV-1 Env position 507; the N-terminal residue of the gp41 ectodomain is HIV-1 Env position 512; and the C-terminal residue of the gp41 ectodomain is HIV-1 Env position 664. In some embodiments, the C-terminal residue of the recombinant HIV-1 Env ectodomain is position 683 (the entire ectodomain, terminating just before the transmembrane domain). In additional embodiments, the C-terminal residue of the recombinant HIV-1 Env ectodomain is position 707 (the entire ectodomain, terminating just after the transmembrane domain).

In several embodiments, the HIV-1 Env ectodomain trimer includes one or more non-natural disulfide bonds for stabilization in a particular conformation, such as the prefusion mature closed conformation. The prefusion mature closed conformation of the HIV-1 Env trimer has been disclosed, for example, in Pancera et al., Nature, 514, 455-461, 2014 and PCT App. No. PCT/US2015/048729, each of which is incorporated by reference herein in its entirety. In some embodiments, any of the recombinant gp120 proteins and/or the HIV-1 Env ectodomain trimer including the recombinant gp120 protein disclosed herein can further include one or more modifications as disclosed in PCT App. No. PCT/US2015/048729 to stabilize the recombinant gp120 protein and/or the HIV-1 Env ectodomain trimer including the recombinant gp120 protein in the prefusion mature closed conformation. For example, the HIV-1 Env ectodomain trimer can include a prefusion mature closed conformation wherein the V1V2 domain of each Env ectodomain protomer in the trimer comes together at the membrane distal apex. At the membrane proximal aspect, the HIV-1 Env ectodomain trimer in the prefusion mature closed conformation includes distinct α6 and α7 helices; the α7 helix does not start until after residue 570. For example, in the prefusion mature closed conformation, the interprotomer distance between residues 200 and 313 can be less than 5 Angstroms.

Stabilization of the recombinant HIV-1 Env ectodomain trimer or immunogenic fragment in the prefusion mature closed conformation prevents transition of the HIV-1 Env ectodomain to the CD4-bound open conformation. Thus, the disclosed recombinant HIV-1 Env ectodomain trimers can be specifically bound by an antibody that is specific for the mature closed conformation of HIV-1 Env (e.g., VRC26, PGT151, PGT122, or PGT145), but are not specifically bound by an antibody specific for the CD4-bound open conformation, of HIV-1 Env (e.g., 17b mAb in the presence of sCD4). In one example, the recombinant HIV-1 Env ectodomain trimer is not specifically bound by an antibody specific for a CD4-induced epitope on the recombinant HIV-1 Env ectodomain trimer, such as the 17b antibody. Methods of determining if a recombinant HIV-1 Env ectodomain trimer includes a CD4-induced epitope are known in the art and disclosed herein (See Examples 1 and 2). For example, the antibody binding assay can be conducted in the presence of a molar excess of soluble CD4 as described in Sanders et al. (Plos Pathogens, 9, e1003618, 2013).

In several embodiments, the recombinant HIV-1 Env ectodomain trimers can be specifically bound by an antibody that specifically binds to the V1V2 domain on a HIV-1 Env trimer, but not an Env monomer. Exemplary antibodies with such antigen binding characteristics include the PGT141, PGT142, PGT143, PGT144, PGT145, and VRC26 antibodies. Additional examples include the PG9, PG16, and CH01-CH04 antibodies. Accordingly, in some embodiments the recombinant HIV-1 Env ectodomain trimer specifically binds to an antibody (such as a PGT141, PGT142, PGT143, PGT144, PGT145, and VRC26 antibody) that specifically binds to the V1V2 domain of a HIV-1 Env in its trimeric, but not monomeric, form with a dissociation constant of less than $10^{-6}$ Molar, such as less than $10^{-7}$ Molar, less than $10^{-8}$ Molar, or less than $10^{-9}$ Molar. Specific binding can be determined by methods known in the art. The determination of specific binding may readily be made by using or adapting routine procedures, such as ELISA, immunocompetition, surface plasmon resonance, or other immunosorbant assays (described in many standard texts, including Harlow and Lane, *Using Antibodies: A Laboratory Manual*, CSHL, New York, 1999).

The recombinant HIV-1 Env ectodomain trimers are stabilized in the prefusion mature closed conformation by one or more amino acid substitutions. Thus, the recombinant HIV-1 Env ectodomain trimers or immunogenic fragments are not stabilized by non-specific crosslinking, for example glutaraldehyde crosslinking of membrane bound HIV-1 Env trimers. Several embodiments include a multiple of the recombinant HIV-1 Env ectodomain trimer, for example, a multiple including 2, 3, 4, 5, 6, 7, 8, 9, or 10, or more of the recombinant HIV-1 Env ectodomain trimers or immunogenic fragment thereof.

HIV-1 can be classified into four groups: the "major" group M, the "outlier" group O, group N, and group P. Within group M, there are several genetically distinct clades (or subtypes) of HIV-1. The disclosed recombinant HIV-1 Env proteins can be derived from any type of HIV, such as groups M, N, O, or P, or Glade, such as Glade A, B, C, D, F, G, H, J, or K, and the like. HIV-1 Env proteins from the different HIV-1 clades, as well as nucleic acid sequences encoding such proteins and methods for the manipulation and insertion of such nucleic acid sequences into vectors, are known (see, e.g., HIV Sequence Compendium, Division of AIDS, National Institute of Allergy and Infectious Diseases (2013); HIV Sequence Database (hiv-web.lanl.gov/content/hiv-db/mainpage.html); see, e.g., Sambrook et al. (Molecular Cloning: A Laboratory Manual, $4^{th}$ ed, Cold Spring Harbor, New York, 2012) and Ausubel et al. (In Current Protocols in Molecular Biology, John Wiley & Sons, New York, through supplement 104, 2013). Exemplary native HIV-1 Env protein sequences are available in the HIV Sequence Database (hiv-web.lanl.gov/content/hiv-db/main-page.html).

In some embodiments, any of the HIV-1 Env ectodomain trimers including the recombinant gp120 proteins disclosed herein can include an amino acid sequence of a native gp120 protein or HIV-1 Env protein, for example, from genetic subtype A-F as available in the HIV Sequence Database (hiv-web.lanl.gov/content/hiv-db/mainpage.html) or as set forth in Table 1, or an amino acid sequence at least 90% (such as at least 95%, at least 96%, at least 97%, at least 98% or at least 99%) identical thereto that has been modified by one or more amino acid substitutions and/or insertions as discussed herein, for example, to stabilize the recombinant gp120 protein or HIV-1 Env ectodomain trimer in the prefusion mature closed conformation.

TABLE 1

Exemplary HIV-1 Env sequences. HXB2 positions 113, 332, 429 and 421 are shown in bold underline.

HXB2 (Clade B, SEQ ID NO: 1):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWDQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQKVGKAMYAPPISGQIRCSSNITGLLLTRDGGNSNNESEIFRPGGGD
MRDNWRSELYKYKVVKIEPLGVAPTKAKRRVVQREKRAVGIGALFLGFLGAAGSTMGAASMTLTVQARQLLSGIVQQQN
NLLRAIEAQQHLLQLTVWGIKQLQARILAVERYLKDQQLLGIWGCSGKLICTTAVPWNASWSNKSLEQIWNHTTWMEWD
REINNYTSLIHSLIEESQNQQEKNEQELLELDKWASLWNWFNITNWLWYIKLFIMIVGGLVGLRIVFAVLSIVNRVRQG
YSPLSFQTHLPTPRGPDRPEGIEEEGGERDRDRSIRLVNGSLALIWDDLRSLCLFSYHRLRDLLLIVTRIVELLGRRGW
EALKYWWNLLQYWSQELKNSAVSLLNATAIAVAEGTDRVIEVVQGACRAIRHIPRRIRQGLERILL BG505 (Clade A, SEQ ID NO: 2):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCTVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQRIGQAMYAPPIQGVIRCVSNITGLILTRDGGSTNSTTETFRPGGGDMRD
NWRSELYKYKVVKIEPLGVAPTRAKRRVVGREKRAVGIGAVFLGFLGAAGSTMGAASMTLTVQARNLLSGIVQQQSNLL
RAIEAQQHLLKLTVWGIKQLQARVLAVERYLRDQQLLGIWGCSGKLICTTNVPWNSSWSNRNLSEIWDNMTWLQWDKEI
SNYTQIIYGLLEESQNQQEKNEQDLLALDKWASLWNWFDISNWLWYIKIFIMIVGGLIGLRIVFAVLSVIHRVRQGYSP
LSFQTHTPNPRGLDRPERIEEEDGEQDRGRSTRLVSGFLALAWDDLRSLCLFCYHRLRDFILIAARIVELLGHSSLKGL
RLGWEGLKYLWNLLAYWGRELKISAINLFDTIAIAVAEWTDRVIEIGQRLCRAFLHIPRRIRQGLERALL CONSENSUS_A1 (Clade A, SEQ ID NO: 3):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWDQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQRAGQAMYAPPIQGVIRCESNITGLLLTRDGGNNNTNETFRPGGGDMRDNWRSELYKYKVVKIE
PLGVAPTRAKRRVVEREKRAVGIGAVFLGFLGAAGSTMGAASITLTVQARQLLSGIVQQQSNLLRAIEAQQHLLKLTVW
GIKQLQARVLAVERYLKDQQLLGIWGCSGKLICTTNVPWNSSWSNKSQNEIWDNMTWLQWDKEISNYTHIIYNLIEESQ
NQQEKNEQDLLALDKWANLWNWFDISNWLWYIKIFIMIVGGLIGLRIVFAVLSVINRVRQGYSPLSFQTHTPNPRGLDR
PGRIEEEGGEQGRDRSIRLVSGFLALAWDDLRSLCLFSYHRLRDFILIAARTVELLGHSSLKGLRLGWEGLKYLWNLLL
YWGRELKISAINLVDTIAIAVAGWTDRVIEIGQRIGRAILHIPRRIRQGLERALL TABLE 1-continued Exemplary HIV-1 Env sequences. HXB2 positions 113, 332, 429 and 421 are shown in bold underline.

CONSENSUS_A2 (Clade A, SEQ ID NO: 4):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWDQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQRVGRAMYAPPIAGVIKCTSNITGIILTRDGGNNETETFRPGGGDMRDNWRSELYKYKVVKIEPL
GVAPTRAKRRVVEREKRAVGMGAVFLGFLGAAGSTMGAASITLTVQARQLLSGIVQQQSNLLKAIEAQQHLLKLTVWGI
KQLQARVLALERYLQDQQLLGIWGCSGKLICATTVPWNSSWSNKTQEEIWNNMTWLQWDKEISNYTNIIYKLLEESQNQ
QEKNEQDLLALDKWANLWNWFNITNWLWYIRIFIMIVGGLIGLRIVIAIISVVNRVRQGYSPLSFQIPTPNPEGLDRPG
RIEEGGGEQGRDRSIRLVSGFLALAWDDLRSLCLFSYHRLRDCILIAARTVELLGHSSLKGLRLGWEGLKYLWNLLLYW
GRELKNSAISLLDTIAVAVAEWTDRVIEIGQRACRAILNIPRRIRQGFERALL CONSENSUS_B (Clade B, SEQ ID NO: 5):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWDQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQEVGKAMYAPPIRGQIRCSSNITGLLLTRDGGNNETEIFRPGGGDMRDNWRSELYKYKVV
KIEPLGVAPTKAKRRVVQREKRAVGIGAMFLGFLGAAGSTMGAASMTLTVQARQLLSGIVQQQNNLLRAIEAQQHLLQL
TVWGIKQLQARVLAVERYLKDQQLLGIWGCSGKLICTTAVPWNASWSNKSLDEIWDNMTWMEWEREIDNYTSLIYTLIE
ESQNQQEKNEQELLELDKWASLWNWFDITNWLWYIKIFIMIVGGLVGLRIVFAVLSIVNRVRQGYSPLSFQTRLPAPRG
PDRPEGIEEEGGERDRDSGRLVDGFLALIWDDLRSLCLFSYHRLRDLLLIVTRIVELLGRRGWEVLKYWWNLLQYWSQ
ELKNSAVSLLNATAIAVAEGTDRVIEVVQRACRAILHIPRRIRQGLERALL CONSENSUS_C (Clade C, SEQ ID NO: 6):
MRVRGILRNCQQWWIWGILGFWMLMICNVVGNLWVTVYYGVPVWKEAKTTLFCASDAKAYEKEVHNVWATHACVPTDPN
PQEIVLENVTENFNMWKNDMVDQMHEDIISLWDQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCGEFFYCNTSKLFNSTYNSTNSTITLPCRIK
QIINMWQEVGRAMYAPPIAGNITCKSNITGLLLTRDGGKNNTETFRPGGGDMRDNWRSELYKYKVVEIKPLGIAPTKAK
RRVVEREKRAVGIGAVFLGFLGAAGSTMGAASITLTVQARQLLSGIVQQQSNLLRAIEAQQHMLQLTVWGIKQLQARVL
AIERYLKDQQLLGIWGCSGKLICTTAVPWNSSWSNKSQEDIWDNMTWMQWDREISNYTDTIYRLLEDSQNQQEKNEKDL
LALDSWKNLWNWFDITNWLWYIKIFIMIVGGLIGLRIIFAVLSIVNRVRQGYSPLSFQTLTPNPRGPDRLGRIEEEGE
QDRDRSIRLVSGFLALAWDDLRSLCLFSYHRLRDFILIAARAVELLGRSSLRGLQRGWEALKYLGSLVQYWGLELKKSA
ISLLDTIAIAVAEGTDRIIELIQRICRAIRNIPRRIRQGFEAALQ CONSENSUS_D (Clade D, SEQ ID NO: 7):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWDQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIRSENLTNNAKIIIVQLNESVTINCTRPYNNTRQRTPIGPGQALYTTRIK
GDIRQAHCNISRAEWNKTLQQVAKKLGDLLNKTTIIFKPSSGGDPEITTHSFNCGGEFFYCNTSRLFNSTWNNTKWNST
GKITLPCRIKQIINMWQGVGKAMYAPPIEGLIKCSSNITGLLLTRDGGANNHNETFRPGGGDMRDNWRSELYKYKVVK
IEPLGVAPTRAKRRVVEREKRAIGLGAMFLGFLGAAGSTMGAASMTLTVQARQLLSGIVQQQNNLLRAIEAQQHLLQLT
VWGIKQLQARILAVERYLKDQQLLGIWGCSGKHICTTTVPWNSSWSNKSLDEIWNNMTWMEWEREIDNYTGLIYSLIEE
SQNQQEKNEQELLELDKWASLWNWFSITQWLWYIKIFIMIVGGLIGLRIVFAVLSLVNRVRQGYSPLSFQTLLPAPRGP
DRPEGIEEEGGEQGRGRSIRLVNGFSALIWDDLRNLCLFSYHRLRDLILIAARIVELLGRRGWEALKYLWNLLQYWIQE
LKNSAISLFDTTAIAVAEGTDRVIEIVQRACRAILNIPTRIRQGLERALL CONSENSUS_F1 (Clade F, SEQ ID NO: 8):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWDQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQEVGRAMYAAPIAGNITCNSNITGLLLTRDGGQNNTETFRPGGGDMRDNWRSELYKYKVVEIEPLGVAP
TKAKRQVVKRERRAVGIGAVFLGFLGAAGSTMGAASITLTVQARQLLSGIVQQQNNLLRAIEAQQHLLQLTVWGIKQLQ
ARVLAVERYLKDQQLLGIWGCSGKLICTTNVPWNSSWSNKSQDEIWNNMTWMEWEKEISNYSNIIYRLIEESQNQQEKN
EQELLALDKWASLWNWFDISNWLWYIKIFIMIVGGLIGLRIVFAVLSIVNRVRKGYSPLSLQTLIPSPREPDRPEGIEE
GGGEQGKDRSVRLVNGFLALVWDDLRNLCLFSYRLRDFILIAARIVDRGLRRGWEALKYLGNLTQYWSQELKNSAISL
LNTTAIVVAEGTDRVIEALQRAGRAVLNIPRRIRQGLERALL CONSENSUS_F2 (Clade F, SEQ ID NO: 9):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWDQSLKPCVKLTPLCVTLNCTDVNVTINTTNVTLGEIKNCSFNITTEI
KDKKKKEYALFYRLDVVPINNNSIVYRLISCNTSTVTQACPKVSEPIPIHYCAPAGFAILKCNDKKFNGTGLCRNVSTV
QCTHGIRPVVSTQLLLNGSLAEEDIIIRSENISDNKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQRVGRAMYAPPIAGQIQCNSNITGLLLTRDGGKNGSETLRPGGGDMRDNWRSELYKYKVVKIEPLGVAPT
KAKRQVVQREKRAVGIGAVLLGFLGAAGSTMGAASITLTVQARQLLSGIVQQQSNLLKAIEAQQHLLQLTVWGIKQLQA
RILAVERYLKDQQLLGIWGCSGKLICTTNVPWNSSWSNKSQDEIWDNMTWMQWEKEISNYSDTIYRLIEDAQNQQEKNE
QDLLALDKWDNLWSWFTITNWLWYIKIFIMIVGGLIGLRIVFAVLSVVNRVRQGYSPLSLQTLIPNPRGPERPGGIEEE TABLE 1-continued Exemplary HIV-1 Env sequences. HXB2 positions 113, 332, 429 and 421 are shown in bold underline.

GGEQDRDRSIRLVSGFLALAWDDLRSLCLFSYRHLRDFILIAARTVDMGLKRGWEALKYLWNLPQYWGQELKNSAISLL
DTTAIAVAEGTDRIIEVLQRAGRAVLHIPRRIRQGFERALL

JRFL (Clade B, SEQ ID NO: 10):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWDQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQEVGKAMYAPPIRGQIRCSSNITGLLLTRDGGINENGTEIFRPGGGDMRDNWRSEL
YKYKVVKIEPLGVAPTKAKRRVVQREKRAVGIGAVFLGFLGAAGSTMGAASMTLTVQARLLLSGIVQQQNNLLRAIEAQ
QRMLQLTVWGIKQLQARVLAVERYLGDQQLLGIWGCSGKLICTTAVPWNASWSNKSLDRIWNNMTWMEWEREIDNYTSE
IYTLIEESQNQQEKNEQELLELDKWASLWNWFDITKWLWYIKIFIMIVGGLVGLRLVFTVLSIVNRVRQGYSPLSFQTL
LPAPRGPDRPEGIEEEGGERDRDRSGRLVNGFLALIWVDLRSLCLFSYHRLRDLLLTVTRIVELLGRRGWEVLKYWWNL
LQYWSQELKNSAVSLLNATAIAVAEGTDRIIEALQRTYRAILHIPTRIRQGLERALL BaL (Clade B, SEQ ID NO: 11):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWDQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNVTEESNNTVENNTITLPCRIKQIINMWQKVGRAMYAPPIRGQIRCSSNITGLLLTRDGGPEDNKTEVFRPGGGDM
RDNWRSELYKYKVVKIEPLGVAPTKAKRRVVQREKRAVGIGAVFLGFLGAAGSTMGAASMTLTVQARLLLSGIVQQQNN
LLRAIEAQQHLLQLTVWGIKQLQARVLAVERYLRDQQLLGIWGCSGKLICTTAVPWNASWSNKSLNKIWDNMTWMEWDR
EINNYTSIIYSLIEESQNQQEKNEQELLELDKWASLWNWFEITEWLWYIKIFIMIIGGLIGLRIVFSVLSIMNRVRQGY
SPLSFQTHLPASRGPDRPGGIEEEGGERDRDSGRLVNGSLALIWDDLRSLCLFSYHRLRDLLLIVTRIVELLGRRGWE
ALKYWWNLLQYWSQELKNSAVSLLNATAIAVAEGTDRVIEVVQGACRAIRHIPRRIRQGLERILL NL4.3 (Clade B, SEQ ID NO: 12):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWDQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQKVGKAMYAPPISGQIRCSSNITGLLLTRDGGNNNNGSEIFRPGGGDMR
DNWRSELYKYKVVKIEPLGVAPTKAKRRVVQREKRAVGIGALFLGFLGAAGSTMGAASMTLTVQARQLLSDIVQQQNNL
LRAIEAQQHLLQLTVWGIKQLQARILAVERYLKDQQLLGIWGCSGKLICTTAVPWNASWSNKSLEQIWNNMTWMEWDRE
INNYTSLIHSLIEESQNQQEKNEQELLELDKWASLWNWFNITNWLWYIKLFIMIVGGLVGLRIVFAVLSIVNRVRQGYS
PLSFQTHLPIPRGPDRPEGIEEEGGERDRDRSIRLVNGSLALIWDDLRSLCLFSYHRLRDLLLIVTRIVELLGRRGWEA
LKYWWNLLQYWSQELKNSAVNLLNATAIAVAEGTDRVIEVLQAAYRAIRHIPRRIRQGLERILL B41 (Clade B, SEQ ID NO: 13):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWDQSLKPCVKLTPLCVTLNCTDLTKNSTTNNSTATNNTTNNSTEKM
EMDKGEMKNCSFNITTNIRDKMQKEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQEVGKAMYAPPIRGQINCSSNITGLLLTRDGGESN
KTIEVFRPGGGDMRDNWRSELYKYKVVKIEPLGVAPTKAKRRVVQREKRAVGLGALFVGFLGAAGSTMGAASITLTVQA
RQLLSGIVQQQNNLLRAIEAQQHLLQLTVWGVKQLQARVLAVERYLKDQQLLGLWGCSGKLICTTAVPWNTSWSNKSYD
YIWDNMTWMQWEREIDNYTGVIYKLIEESQNQQEKNEQELLALDKWANLWNWFDITRWLWYIKIFIMIVGGLVGLRIVF
AVLSIVNRVRQGYSPLSLQTHFPAPRGPDRPEGTEEEGGDRDRDRSTPLVDGFLAIIWVDLRSLFLFSYHRLRDLLLIV
TRIVELLGRRGWEALKYWWNLLQYWSQELRNSAVSLFNATAIAVAEGTDRVIEAVQRIGRAILHIPRRIRQGFERALQ ZM197M (Clade C, SEQ ID NO: 14):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWDQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIRSENLTDNTKTIIVHLNESVEIECV
RPNNNTRKSVRIGPGQTFFATGEIIGDIRQAHCDLSKSNWTTTLKRIEKKLKEHFNNATIKFESSAGGDLEITTHSFNC
RGEFFYCNTSGLFNSSLLNDTGTSNSTSNATITLPCRIKQIINMWQEVGRAMYASPIAGIITCKSNITGLLLTRDGGN
KSAGIETFRPGGGNMKDNWRSELYKYKVVEIKPLGIAPTSAKRRVVEREKRAAGIGAVILGFLGAAGSTMGAASVMLTV
QARQLLSGIVQQQSNLLRAIEAQQHMLQLTVWGIKQLQTRVLAIERYLKDQQLLGLWGCSGKLICTTAVPWNTSWSNKS
KDEIWDNMTWMQWDREIDNYTQVIYQLLEVSQNQQEKNENDLLALDKWNSLWSWFDITKWLWYIKIFIMIVGGLIGLRI
IFAVLSVVNRVRQGYSPLSFQTLIPNPRGPDRPGGIEEEGGEQDKNRSTRLVSGFLALVWDDLRSLCLFSYHRLRDFIL
IAARAVELLGRSSLEGLQWGWETLKYLRNLVQYWGLELKQSAINLLDTIAIQVAEGTDRIIELIQRIFRAICNIPTRIR
QGFEAALQ DU422 (Clade C, SEQ ID NO: 15):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWDQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQEVGRAMYAPPIEGNITCKSNITGLLLTWDGGENSTEGVFRPGGGNMKDNW
RSELYKYKVVEIKPLGVAPTKSKRKVVGREKRAVGLGAVLLGFLGAAGSTMGAASITLTVQARQLLSGIVQQQSNLLRA TABLE 1-continued Exemplary HIV-1 Env sequences. HXB2 positions 113, 332, 429 and 421 are shown in bold underline.

```
IEAQQHLLQLTVWGIKQLQTRVLAIERYLKDQQLLGLWGCSGKLICATAVPWNSSWSNKSLGDIWDNMTWMQWDREISN
YTNTIFRLLEDSQNQQEKNEKDLLALDSWKNLWNWFDITNWLWYIKIFIMIVGGLIGLRIIFGVLAIVKRVRQGYSPLS
FQTLIPNPRGPDRLGRIEEEGGEQDKDRSIRLVSGFLALAWDDLRSLCLFSYHQLRDFILTAARAAELLGRSSLRGLQR
GWEVLKYLGNLVQYWGLELKRSAINLFDTIAIAVAEGTDRIIEVIQRICRAIRYIPTRIRQGFEAALL
```

In view of the conservation and breadth of knowledge of HIV-1 Env sequences, the person of ordinary skill in the art can easily identify corresponding HIV-1 Env amino acid positions between different HIV-1 Env strains and subtypes. The HXB2 numbering system has been developed to assist comparison between different HIV-1 amino acid and nucleic acid sequences. The numbering of amino acid substitutions disclosed herein is made according to the HXB2 numbering system, unless context indicates otherwise.

It is understood in the art that some variations can be made in the amino acid sequence of a protein without affecting the activity of the protein. Such variations include insertion of amino acid residues, deletions of amino acid residues, and substitutions of amino acid residues. These variations in sequence can be naturally occurring variations or they can be engineered through the use of genetic engineering technique known to those skilled in the art. Examples of such techniques are found in see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013, both of which are incorporated herein by reference in their entirety.

The recombinant HIV-1 Env ectodomain can include modifications of the native HIV-1 sequence, such as amino acid substitutions, deletions or insertions, glycosylation and/or covalent linkage to unrelated proteins (e.g., a protein tag), as long as the recombinant HIV-1 Env ectodomain can form a trimer that is stabilized in the prefusion mature closed conformation. HIV-1 Env proteins from the different Clades, as well as nucleic acid sequences encoding such proteins and methods for the manipulation and insertion of such nucleic acid sequences into vectors, are disclosed herein and known in the art.

In several embodiments, the recombinant HIV-1 Env ectodomain trimer is soluble in aqueous solution. In some embodiments, the recombinant HIV-1 Env ectodomain trimer dissolves to a concentration of at least 0.5 mg/ml (such as at least 1.0 mg/ml, 1.5 mg/ml, 2.0 mg/ml, 3.0 mg/ml, 4.0 mg/ml or at least 5.0 mg/ml) in phosphate buffered saline (pH 7.4) at room temperature (e.g., 20-22 degrees Celsius) and remains dissolved for at least for at least 12 hours (such as at least 24 hours, at least 48 hours, at least one week, at least two weeks, or more time). In one embodiment, the phosphate buffered saline includes NaCl (137 mM), KCl (2.7 mM), Na$_2$HPO$_4$ (10 mM), KH$_2$PO$_4$ (1.8 mM) at pH 7.4. In some embodiments, the phosphate buffered saline further includes CaCl$_2$ (1 mM) and MgCl$_2$ (0.5 mM). The person of skill in the art is familiar with methods of determining if a protein remains in solution over time. For example, the concentration of the protein dissolved in an aqueous solution can be tested over time using standard methods.

The recombinant gp120 protein and/or the HIV-1 Env ectodomain trimer including the recombinant gp120 protein can be derivatized or linked to another molecule (such as another peptide or protein). In general, the recombinant gp120 protein and/or the HIV-1 Env ectodomain trimer including the recombinant gp120 protein is derivatized such that the binding to broadly neutralizing antibodies to a trimer of the recombinant HIV-1 ectodomain, such as PGT122, is not affected adversely by the derivatization or labeling. For example, the recombinant gp120 protein and/or the HIV-1 Env ectodomain trimer including the recombinant gp120 protein can be functionally linked (by chemical coupling, genetic fusion, noncovalent association or otherwise) to one or more other molecular entities, such as an antibody or protein or detection tag.

In several embodiments, the recombinant gp120 protein and/or the HIV-1 Env ectodomain trimer including the recombinant gp120 protein includes one or more non-natural disulfide bonds that stabilize the HIV-1 Env ectodomain trimer in the prefusion mature closed conformation. The cysteine residues that form the disulfide bond can be introduced into a native HIV-1 sequence by one or more amino acid substitutions. For example, the amino acid positions of the cysteines are typically within a sufficiently close distance for formation of a disulfide bond in the prefusion mature closed conformation of the HIV-1 Env protein trimer. Methods of using three-dimensional structure data to determine if two residues are within a sufficiently close distance to one another for disulfide bond formation are known (see, e.g., Peterson et al., *Protein engineering*, 12:535-548, 1999 and Dombkowski, *Bioinformatics*, 19:1852-1853, 3002 (disclosing DISULFIDE BY DESIGN™), each of which is incorporated by reference herein). Residues can be selected manually, based on the three dimensional structure of the HIV-1 Env trimer in a prefusion mature closed conformation provided herein, or a software, such as DISULFIDE-BYDESIGN™, can be used. Without being bound by theory, ideal distances for formation of a disulfide bond are generally considered to be about ~5.6 Å for Cα-Cα distance, ~2.02 Å for Sγ-Sγ distance, and 3.5-4.25 Å for Cβ-Cβ distance (using the optimal rotomer). Variations from these distances are included when selecting residues in a three dimensional structure that can be substituted for cysteines for introduction of a disulfide bond. For example, in some embodiments the selected residues have a Cα-Cα distance of less than 7.0 Å and/or a Cβ-Cβ distance of less than 4.7 Å. In some embodiments the selected residues have a Cα-Cα distance of from 2.0-8.0 Å and/or a Cβ-Cβ distance of from 2.0-5.5 Å. In several embodiments, the amino acid positions of the cysteines are within a sufficiently close distance for formation of a disulfide bond in the prefusion mature closed conformation, but not the CD4-bound open conformation of the HIV-1 Env protein.

Exemplary Sequences

The following table provides sequences of gp160 and gp140 proteins including D113C/X429GCG substitutions or D113C/G431GCG substitutions, and for the gp140 proteins, the SOSIP substitutions. The recombinant gp120 protein or HIV-1 Env ectodomain trimer including the recombinant gp120 protein disclosed herein can include relevant sequences of the recombinant HIV-1 Env sequences provided below. Any of the other stabilizing mutations (such as 201C-433C substitutions) provided herein can also be included in the recombinant gp120 protein or HIV-1 Env ectodomain trimer.

TABLE 2

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

HXB2 D113C/K429GCG gp160 (SEQ ID NO: 22):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQGCGVGKAMYAPPISGQIRCSSNITGLLLTRDGGNSNNESEIFRPGG
GDMRDNWRSELYKYKVVKIEPLGVAPTKAKRRVVQREKRAVGIGALFLGFLGAAGSTMGAASMTLTVQARQLLSGIVQQ
QNNLLRAIEAQQHLLQLTVWGIKQLQARILAVERYLKDQQLLGIWGCSGKLICTTAVPWNASWSNKSLEQIWNHTTWME
WDREINNYTSLIHSLIEESQNQQEKNEQELLELDKWASLWNWFNITNWLWYIKLFIMIVGGLVGLRIVFAVLSIVNRVR
QGYSPLSFQTHLPTPRGPDRPEGIEEEGGERDRDRSIRLVNGSLALIWDDLRSLCLFSYHRLRDLLLIVTRIVELLGRR
GWEALKYWWNLLQYWSQELKNSAVSLLNATAIAVAEGTDRVIEVVQGACRAIRHIPRRIRQGLERILL

HXB2 D113C/G431GCG gp160 (SEQ ID NO: 23):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQKVGCGKAMYAPPISGQIRCSSNITGLLLTRDGGNSNNESEIFRPGG
GDMRDNWRSELYKYKVVKIEPLGVAPTKAKRRVVQREKRAVGIGALFLGFLGAAGSTMGAASMTLTVQARQLLSGIVQQ
QNNLLRAIEAQQHLLQLTVWGIKQLQARILAVERYLKDQQLLGIWGCSGKLICTTAVPWNASWSNKSLEQIWNHTTWME
WDREINNYTSLIHSLIEESQNQQEKNEQELLELDKWASLWNWFNITNWLWYIKLFIMIVGGLVGLRIVFAVLSIVNRVR
QGYSPLSFQTHLPTPRGPDRPEGIEEEGGERDRDRSIRLVNGSLALIWDDLRSLCLFSYHRLRDLLLIVTRIVELLGRR
GWEALKYWWNLLQYWSQELKNSAVSLLNATAIAVAEGTDRVIEVVQGACRAIRHIPRRIRQGLERILL

HXB2 D113C/K432GCG gp160 (SEQ ID NO: 84):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQKVGKGCGAMYAPPISGQIRCSSNITGLLLTRDGGNSNNESEIFRPG
GGDMRDNWRSELYKYKVVKIEPLGVAPTKAKRRVVQREKRAVGIGALFLGFLGAAGSTMGAASMTLTVQARQLLSGIVQ
QQNNLLRAIEAQQHLLQLTVWGIKQLQARILAVERYLKDQQLLGIWGCSGKLICTTAVPWNASWSNKSLEQIWNHTTWM
EWDREINNYTSLIHSLIEESQNQQEKNEQELLELDKWASLWNWFNITNWLWYIKLFIMIVGGLVGLRIVFAVLSIVNRV
RQGYSPLSFQTHLPTPRGPDRPEGIEEEGGERDRDRSIRLVNGSLALIWDDLRSLCLFSYHRLRDLLLIVTRIVELLGR
RGWEALKYWWNLLQYWSQELKNSAVSLLNATAIAVAEGTDRVIEVVQGACRAIRHIPRRIRQGLERILL

HXB2 D113C/K429GCG SOSIP (SEQ ID NO: 24):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQGCGVGKAMYAPPISGQIRCSSNITGLLLTRDGGNSNNESEIFRPGG
GDMRDNWRSELYKYKVVKIEPLGVAPTKCKRRVVQREKRAVGIGALFLGFLGAAGSTMGAASMTLTVQARQLLSGIVQQ
QNNLLRAPEAQQHLLQLTVWGIKQLQARILAVERYLKDQQLLGIWGCSGKLICCTAVPWNASWSNKSLEQIWNHTTWME
WDREINNYTSLIHSLIEESQNQQEKNEQELLELD

HXB2 D113C/G431GCG SOSIP (SEQ ID NO: 25):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQKVGCGKAMYAPPISGQIRCSSNITGLLLTRDGGNSNNESEIFRPGG
GDMRDNWRSELYKYKVVKIEPLGVAPTKCKRRVVQREKRAVGIGALFLGFLGAAGSTMGAASMTLTVQARQLLSGIVQQ
QNNLLRAPEAQQHLLQLTVWGIKQLQARILAVERYLKDQQLLGIWGCSGKLICCTAVPWNASWSNKSLEQIWNHTTWME
WDREINNYTSLIHSLIEESQNQQEKNEQELLELD

HXB2 D113C/K432GCG SOSIP (SEQ ID NO: 85):
MRVKEKYQHLWRWGWRWGTMLLGMLMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRGKVQKEYAFFYKLDIIPIDNDTTSYKLTSCNTSVITQACPKVSFEPIPIHYCAPAGFAILKCNNKTFNGTG
PCTNVSTVQCTHGIRPVVSTQLLLNGSLAEEEVVIRSVNFTDNAKTIIVQLNTSVEINCTRPNNNTRKRIRIQRGPGRA
FVTIGKIGNMRQAHCNISRAKWNNTLKQIASKLREQFGNNKTIIFKQSSGGDPEIVTHSFNCGGEFFYCNSTQLFNSTW
FNSTWSTEGSNNTEGSDTITLPCRIKQIINMWQKVGKGCGAMYAPPISGQIRCSSNITGLLLTRDGGNSNNESEIFRPG
GGDMRDNWRSELYKYKVVKIEPLGVAPTKCKRRVVQREKRAVGIGALFLGFLGAAGSTMGAASMTLTVQARQLLSGIVQ
QQNNLLRAPEAQQHLLQLTVWGIKQLQARILAVERYLKDQQLLGIWGCSGKLICCTAVPWNASWSNKSLEQIWNHTTWM
EWDREINNYTSLIHSLIEESQNQQEKNEQELLELD

TABLE 2-continued Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

BG505 D113C/R429GCG, T332N gp160 (SEQ ID NO: 26):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQGCGIGQAMYAPPIQGVIRCVSNITGLILTRDGGSTNSTTETFRPGGGDM
RDNWRSELYKYKVVKIEPLGVAPTRAKRRVVGREKRAVGIGAVFLGFLGAAGSTMGAASMTLTVQARNLLSGIVQQQSN
LLRAIEAQQHLLKLTVWGIKQLQARVLAVERYLRDQQLLGIWGCSGKLICTTNVPWNSSWSNRNLSEIWDNMTWLQWDK
EISNYTQIIYGLLEESQNQQEKNEQDLLALDKWASLWNWFDISNWLWYIKIFIMIVGGLIGLRIVFAVLSVIHRVRQGY
SPLSFQTHTPNPRGLDRPERIEEEDGEQDRGRSTRLVSGFLALAWDDLRSLCLFCYHRLRDFILIAARIVELLGHSSLK
GLRLGWEGLKYLWNLLAYWGRELKISAINLFDTIAIAVAEWTDRVIEIGQRLCRAFLHIPRRIRQGLERALL

BG505 D113C/G431GCG, T332N gp160 (SEQ ID NO: 27):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQRIGCGQAMYAPPIQGVIRCVSNITGLILTRDGGSTNSTTETFRPGGGDM
RDNWRSELYKYKVVKIEPLGVAPTRAKRRVVGREKRAVGIGAVFLGFLGAAGSTMGAASMTLTVQARNLLSGIVQQQSN
LLRAIEAQQHLLKLTVWGIKQLQARVLAVERYLRDQQLLGIWGCSGKLICTTNVPWNSSWSNRNLSEIWDNMTWLQWDK
EISNYTQIIYGLLEESQNQQEKNEQDLLALDKWASLWNWFDISNWLWYIKIFIMIVGGLIGLRIVFAVLSVIHRVRQGY
SPLSFQTHTPNPRGLDRPERIEEEDGEQDRGRSTRLVSGFLALAWDDLRSLCLFCYHRLRDFILIAARIVELLGHSSLK
GLRLGWEGLKYLWNLLAYWGRELKISAINLFDTIAIAVAEWTDRVIEIGQRLCRAFLHIPRRIRQGLERALL

BG505 D113C/Q432GCG, T332N gp160 (SEQ ID NO: 86):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQRIGQGCGAMYAPPIQGVIRCVSNITGLILTRDGGSTNSTTETFRPGGGD
MRDNWRSELYKYKVVKIEPLGVAPTRAKRRVVGREKRAVGIGAVFLGFLGAAGSTMGAASMTLTVQARNLLSGIVQQQS
NLLRAIEAQQHLLKLTVWGIKQLQARVLAVERYLRDQQLLGIWGCSGKLICTTNVPWNSSWSNRNLSEIWDNMTWLQWD
KEISNYTQIIYGLLEESQNQQEKNEQDLLALDKWASLWNWFDISNWLWYIKIFIMIVGGLIGLRIVFAVLSVIHRVRQG
YSPLSFQTHTPNPRGLDRPERIEEEDGEQDRGRSTRLVSGFLALAWDDLRSLCLFCYHRLRDFILIAARIVELLGHSSL
KGLRLGWEGLKYLWNLLAYWGRELKISAINLFDTIAIAVAEWTDRVIEIGQRLCRAFLHIPRRIRQGLERALL

BG505 D113C/R429GCG, T332N SOSIP (SEQ ID NO: 28):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQGCGIGQAMYAPPIQGVIRCVSNITGLILTRDGGSTNSTTETFRPGGGDM
RDNWRSELYKYKVVKIEPLGVAPTRCKRRVVGREKRAVGIGAVFLGFLGAAGSTMGAASMTLTVQARNLLSGIVQQQSN
LLRAPEAQQHLLKLTVWGIKQLQARVLAVERYLRDQQLLGIWGCSGKLICCTNVPWNSSWSNRNLSEIWDNMTWLQWDK
EISNYTQIIYGLLEESQNQQEKNEQDLLALD

BG505 D113C/G431GCG, T332N SOSIP (SEQ ID NO: 29):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQRIGCGQAMYAPPIQGVIRCVSNITGLILTRDGGSTNSTTETFRPGGGDM
RDNWRSELYKYKVVKIEPLGVAPTRCKRRVVGREKRAVGIGAVFLGFLGAAGSTMGAASMTLTVQARNLLSGIVQQQSN
LLRAPEAQQHLLKLTVWGIKQLQARVLAVERYLRDQQLLGIWGCSGKLICCTNVPWNSSWSNRNLSEIWDNMTWLQWDK
EISNYTQIIYGLLEESQNQQEKNEQDLLALD

BG505 D113C/Q432GCG, T332N SOSIP (SEQ ID NO: 87):
MRVMGIQRNCQHLFRWGTMILGMIIICSAAENLWVTVYYGVPVWKDAETTLFCASDAKAYETEKHNVWATHACVPTDPN
PQEIHLENVTEEFNMWKNNMVEQMHTDIISLWCQSLKPCVKLTPLCVTLQCTNVTNNITDDMRGELKNCSFNMTTELRD
KKQKVYSLFYRLDVVQINENQGNRSNNSNKEYRLINCNTSAITQACPKVSFEPIPIHYCAPAGFAILKCKDKKFNGTGP
CPSVSTVQCTHGIKPVVSTQLLLNGSLAEEEVMIRSENITNNAKNILVQFNTPVQINCTRPNNNTRKSIRIGPGQAFYA
TGDIIGDIRQAHCNVSKATWNETLGKVVKQLRKHFGNNTIIRFANSSGGDLEVTTHSFNCGGEFFYCNTSGLFNSTWIS
NTSVQGSNSTGSNDSITLPCRIKQIINMWQRIGQGCGAMYAPPIQGVIRCVSNITGLILTRDGGSTNSTTETFRPGGGD
MRDNWRSELYKYKVVKIEPLGVAPTRCKRRVVGREKRAVGIGAVFLGFLGAAGSTMGAASMTLTVQARNLLSGIVQQQS
NLLRAPEAQQHLLKLTVWGIKQLQARVLAVERYLRDQQLLGIWGCSGKLICCTNVPWNSSWSNRNLSEIWDNMTWLQWD
KEISNYTQIIYGLLEESQNQQEKNEQDLLALD

CONSENSUS_A1 D113C/R429GCG gp160 (SEQ ID NO: 30):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSSSYRLINCNTSAITQACPKVSFEPIPIHYCAPAGFAILKCKDKEFNGTGPCKNV

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

```
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQGCGAGQAMYAPPIQGVIRCESNITGLLLTRDGGNNNTNETFRPGGGDMRDNWRSELYKYKVVK
IEPLGVAPTRAKRRVVEREKRAVGIGAVFLGFLGAAGSTMGAASITLTVQARQLLSGIVQQQSNLLRAIEAQQHLLKLT
VWGIKQLQARVLAVERYLKDQQLLGIWGCSGKLICTTNVPWNSSWSNKSQNEIWDNMTWLQWDKEISNYTHIIYNLIEE
SQNQQEKNEQDLLALDKWANLWNWFDISNWLWYIKIFIMIVGGLIGLRIVFAVLSVINRVRQGYSPLSFQTHTPNPRGL
DRPGRIEEEGGEQGRDRSIRLVSGFLALAWDDLRSLCLFSYHRLRDFILIAARTVELLGHSSLKGLRLGWEGLKYLWNL
LLYWGRELKISAINLVDTIAIAVAGWTDRVIEIGQRIGRAILHIPRRIRQGLERALL

CONSENSUS_A1 D113C/G431GCG gp160 (SEQ ID NO: 31):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQRAGCGQAMYAPPIQGVIRCESNITGLLLTRDGGNNNTNETFRPGGGDMRDNWRSELYKYKVVK
IEPLGVAPTRAKRRVVEREKRAVGIGAVFLGFLGAAGSTMGAASITLTVQARQLLSGIVQQQSNLLRAIEAQQHLLKLT
VWGIKQLQARVLAVERYLKDQQLLGIWGCSGKLICTTNVPWNSSWSNKSQNEIWDNMTWLQWDKEISNYTHIIYNLIEE
SQNQQEKNEQDLLALDKWANLWNWFDISNWLWYIKIFIMIVGGLIGLRIVFAVLSVINRVRQGYSPLSFQTHTPNPRGL
DRPGRIEEEGGEQGRDRSIRLVSGFLALAWDDLRSLCLFSYHRLRDFILIAARTVELLGHSSLKGLRLGWEGLKYLWNL
LLYWGRELKISAINLVDTIAIAVAGWTDRVIEIGQRIGRAILHIPRRIRQGLERALL

CONSENSUS_A1 D113C/Q432GCG gp160 (SEQ ID NO: 88):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQRAGQGCGAMYAPPIQGVIRCESNITGLLLTRDGGNNNTNETFRPGGGDMRDNWRSELYKYKVV
KIEPLGVAPTRAKRRVVEREKRAVGIGAVFLGFLGAAGSTMGAASITLTVQARQLLSGIVQQQSNLLRAIEAQQHLLKL
TVWGIKQLQARVLAVERYLKDQQLLGIWGCSGKLICTTNVPWNSSWSNKSQNEIWDNMTWLQWDKEISNYTHIIYNLIE
ESQNQQEKNEQDLLALDKWANLWNWFDISNWLWYIKIFIMIVGGLIGLRIVFAVLSVINRVRQGYSPLSFQTHTPNPRG
LDRPGRIEEEGGEQGRDRSIRLVSGFLALAWDDLRSLCLFSYHRLRDFILIAARTVELLGHSSLKGLRLGWEGLKYLWN
LLLYWGRELKISAINLVDTIAIAVAGWTDRVIEIGQRIGRAILHIPRRIRQGLERALL

CONSENSUS_A1 D113C/R429GCG SOSIP (SEQ ID NO: 32):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQGCGAGQAMYAPPIQGVIRCESNITGLLLTRDGGNNNTNETFRPGGGDMRDNWRSELYKYKVVK
IEPLGVAPTRCKRRVVEREKRAVGIGAVFLGFLGAAGSTMGAASITLTVQARQLLSGIVQQQSNLLRAPEAQQHLLKLT
VWGIKQLQARVLAVERYLKDQQLLGIWGCSGKLICCTNVPWNSSWSNKSQNEIWDNMTWLQWDKEISNYTHIIYNLIEE
SQNQQEKNEQDLLALD

CONSENSUS_A1 D113C/G431GCG SOSIP (SEQ ID NO: 33):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQRAGCGQAMYAPPIQGVIRCESNITGLLLTRDGGNNNTNETFRPGGGDMRDNWRSELYKYKVVK
IEPLGVAPTRCKRRVVEREKRAVGIGAVFLGFLGAAGSTMGAASITLTVQARQLLSGIVQQQSNLLRAPEAQQHLLKLT
VWGIKQLQARVLAVERYLKDQQLLGIWGCSGKLICCTNVPWNSSWSNKSQNEIWDNMTWLQWDKEISNYTHIIYNLIEE
SQNQQEKNEQDLLALD

CONSENSUS_A1 D113C/Q432GCG SOSIP (SEQ ID NO: 89):
MRVMGIQRNCQHLLRWGTMILGMIIICSAAENLWVTVYYGVPVWKDAETTLFCASDAKAYETEMHNVWATHACVPTDPN
PQEIHLENVTEEFNMWKNNMVEQMHTDIISLWCQSLKPCVKLTPLCVTLNCSNVNVTNNTTNTHEEEIKNCSFNMTTEL
RDKKQKVYSLFYRLDVVQINENNSNSSYRLINCNTSAITQACPKVSFEPIPIHYCAPAGFAILKCKDKEFNGTGPCKNV
STVQCTHGIKPVVSTQLLLNGSLAEEEVIIRSENITNNAKTIIVQLTKPVKINCTRPNNNTRKSIRIGPGQAFYATGDI
IGDIRQAHCNVSRSEWNKTLQKVAKQLRKYFKNKTIIFTNSSGGDLEITTHSFNCGGEFFYCNTSGLFNSTWNNGTMKN
TITLPCRIKQIINMWQRAGQGCGAMYAPPIQGVIRCESNITGLLLTRDGGNNNTNETFRPGGGDMRDNWRSELYKYKVV
KIEPLGVAPTRCKRRVVEREKRAVGIGAVFLGFLGAAGSTMGAASITLTVQARQLLSGIVQQQSNLLRAPEAQQHLLKL
TVWGIKQLQARVLAVERYLKDQQLLGIWGCSGKLICCTNVPWNSSWSNKSQNEIWDNMTWLQWDKEISNYTHIIYNLIE
ESQNQQEKNEQDLLALD

CONSENSUS_A2 D113C/R429GCG gp160 (SEQ ID NO: 34):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQGCGVGRAMYAPPIAGVIKCTSNITGIILTRDGGNNETETFRPGGGDMRDNWRSELYKYKVVKIE
PLGVAPTRAKRRVVEREKRAVGMGAVFLGFLGAAGSTMGAASITLTVQARQLLSGIVQQQSNLLKAIEAQQHLLKLTVW
```

TABLE 2-continued

Exemplary gp160 and gp140 proteins (with SOSIP mutations) with α1/β20-β21 stabilizing
disulfide bonds. HXB2 positions 113 and 332, 429 substitutions, insertions between
431/432, SOSIP substitutions, are shown in bold underline.

```
GIKQLQARVLALERYLQDQQLLGIWGCSGKLICATTVPWNSSWSNKTQEEIWNNMTWLQWDKEISNYTNIIYKLLEESQ
NQQEKNEQDLLALDKWANLWNWFNITNWLWYIRIFIMIVGGLIGLRIVIAIISVVNRVRQGYSPLSFQIPTPNPEGLDR
PGRIEEGGGEQGRDRSIRLVSGFLALAWDDLRSLCLFSYHRLRDCILIAARTVELLGHSSLKGLRLGWEGLKYLWNLLL
YWGRELKNSAISLLDTIAVAVAEWTDRVIEIGQRACRAILNIPRRIRQGFERALL

CONSENSUS_A2 D113C/G431GCG gp160 (SEQ ID NO: 35):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQRVGCGRAMYAPPIAGVIKCTSNITGIILTRDGGNNETETFRPGGGDMRDNWRSELYKYKVVKIE
PLGVAPTRAKRRVVEREKRAVGMGAVFLGFLGAAGSTMGAASITLTVQARQLLSGIVQQQSNLLKAIEAQQHLLKLTVW
GIKQLQARVLALERYLQDQQLLGIWGCSGKLICATTVPWNSSWSNKTQEEIWNNMTWLQWDKEISNYTNIIYKLLEESQ
NQQEKNEQDLLALDKWANLWNWFNITNWLWYIRIFIMIVGGLIGLRIVIAIISVVNRVRQGYSPLSFQIPTPNPEGLDR
PGRIEEGGGEQGRDRSIRLVSGFLALAWDDLRSLCLFSYHRLRDCILIAARTVELLGHSSLKGLRLGWEGLKYLWNLLL
YWGRELKNSAISLLDTIAVAVAEWTDRVIEIGQRACRAILNIPRRIRQGFERALL

CONSENSUS_A2 D113C/R432GCG gp160 (SEQ ID NO: 90):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQRVGRGCGAMYAPPIAGVIKCTSNITGIILTRDGGNNETETFRPGGGDMRDNWRSELYKYKVVKIE
EPLGVAPTRAKRRVVEREKRAVGMGAVFLGFLGAAGSTMGAASITLTVQARQLLSGIVQQQSNLLKAIEAQQHLLKLTV
WGIKQLQARVLALERYLQDQQLLGIWGCSGKLICATTVPWNSSWSNKTQEEIWNNMTWLQWDKEISNYTNIIYKLLEES
QNQQEKNEQDLLALDKWANLWNWFNITNWLWYIRIFIMIVGGLIGLRIVIAIISVVNRVRQGYSPLSFQIPTPNPEGLD
RPGRIEEGGGEQGRDRSIRLVSGFLALAWDDLRSLCLFSYHRLRDCILIAARTVELLGHSSLKGLRLGWEGLKYLWNLL
LYWGRELKNSAISLLDTIAVAVAEWTDRVIEIGQRACRAILNIPRRIRQGFERALL

CONSENSUS_A2 D113C/R429GCG SOSIP (SEQ ID NO: 36):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQGCGVGRAMYAPPIAGVIKCTSNITGIILTRDGGNNETETFRPGGGDMRDNWRSELYKYKVVKIE
PLGVAPTRCKRRVVEREKRAVGMGAVFLGFLGAAGSTMGAASITLTVQARQLLSGIVQQQSNLLKAPEAQQHLLKLTVW
GIKQLQARVLALERYLQDQQLLGIWGCSGKLICCTTVPWNSSWSNKTQEEIWNNMTWLQWDKEISNYTNIIYKLLEESQ
NQQEKNEQDLLALD

CONSENSUS_A2 D113C/G431GCG SOSIP (SEQ ID NO: 37):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQRVGCGRAMYAPPIAGVIKCTSNITGIILTRDGGNNETETFRPGGGDMRDNWRSELYKYKVVKIE
PLGVAPTRCKRRVVEREKRAVGMGAVFLGFLGAAGSTMGAASITLTVQARQLLSGIVQQQSNLLKAPEAQQHLLKLTVW
GIKQLQARVLALERYLQDQQLLGIWGCSGKLICCTTVPWNSSWSNKTQEEIWNNMTWLQWDKEISNYTNIIYKLLEESQ
NQQEKNEQDLLALD

CONSENSUS_A2 D113C/R432GCG SOSIP (SEQ ID NO: 91):
MRVMGTQRNYQHLWRWGILILGMLIMCKATDLWVTVYYGVPVWKDADTTLFCASDAKAYDTEVHNVWATHACVPTDPNP
QEVNLENVTEDFNMWKNNMVEQMHEDIISLWCQSLKPCVKLTPLCVTLNCSNANTTNNSTMEEIKNCSYNITTELRDKT
QKVYSLFYKLDVVQLDESNKSEYYYRLINCNTSAITQACPKVSFEPIPIHYCAPAGFAILKCKDPRFNGTGSCNNVSSV
QCTHGIKPVASTQLLLNGSLAEGKVMIRSENITNNAKNIIVQFNKPVPITCIRPNNNTRKSIRFGPGQAFYTNDIIGDI
RQAHCNINKTKWNATLQKVAEQLREHFPNKTIIFTNSSGGDLEITTHSFNCGGEFFYCNTTGLFNSTWKNGTTNNTEQM
ITLPCRIKQIINMWQRVGRGCGAMYAPPIAGVIKCTSNITGIILTRDGGNNETETFRPGGGDMRDNWRSELYKYKVVKI
EPLGVAPTRCKRRVVEREKRAVGMGAVFLGFLGAAGSTMGAASITLTVQARQLLSGIVQQQSNLLKAPEAQQHLLKLTV
WGIKQLQARVLALERYLQDQQLLGIWGCSGKLICCTTVPWNSSWSNKTQEEIWNNMTWLQWDKEISNYTNIIYKLLEES
QNQQEKNEQDLLALD

CONSENSUS_B D113C/E429GCG gp160 (SEQ ID NO: 38):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLDLMNATNTNTTIIYRWRGEIKNCSFNI
TTSIRDKVQKEYALFYKLDVVPIDNDNTSYRLSCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQGCGVGKAMYAPPIRGQIRCSSNITGLLLTRDGGNNETEIFRPGGGDMRDNWRSELYKYK
VVKIEPLGVAPTKAKRRVVQREKRAVGIGAMFLGFLGAAGSTMGAASMTLTVQARQLLSGIVQQQNNLRAIEAQQHLL
QLTVWGIKQLQARVLAVERYLKDQQLLGIWGCSGKLICTTAVPWNASWSNKSLDEIWDNMTWMEWEREIDNYTSLIYTL
IEESQNQQEKNEQELLELDKWASLWNWFDITNWLWYIKIFIMIVGGLVGLRIVFAVLSIVNRVRQGYSPLSFQTRLPAP
RGPDRPEGIEEEGGERDRDRSGRLVDGFLALIWDDLRSLCLFSYHRLRDLLLIVTRIVELLGRRGWEVLKYWWNLLQYW
SQELKNSAVSLLNATAIAVAEGTDRVIEVVQRACRAILHIPRRIRQGLERALL
```

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

CONSENSUS_B D113C/G431GCG gp160 (SEQ ID NO: 39):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQEVGCGKAMYAPPIRGQIRCSSNITGLLLTRDGGNNETEIFRPGGGDMRDNWRSELYKYK
VVKIEPLGVAPTKAKRRVVQREKRAVGIGAMFLGFLGAAGSTMGAASMTLTVQARQLLSGIVQQQNNLLRAIEAQQHLL
QLTVWGIKQLQARVLAVERYLKDQQLLGIWGCSGKLICTTAVPWNASWSNKSLDEIWDNMTWMEWEREIDNYTSLIYTL
IEESQNQQEKNEQELLELDKWASLWNWFDITNWLWYIKIFIMIVGGLVGLRIVFAVLSIVNRVRQGYSPLSFQTRLPAP
RGPDRPEGIEEEGGERDRDRSGRLVDGFLALIWDDLRSLCLFSYHRLRDLLLIVTRIVELLGRRGWEVLKYWWNLLQYW
SQELKNSAVSLLNATAIAVAEGTDRVIEVVQRACRAILHIPRRIRQGLERALL

CONSENSUS_B D113C/K432GCG gp160 (SEQ ID NO: 92):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQEVGKGCGAMYAPPIRGQIRCSSNITGLLLTRDGGNNETEIFRPGGGDMRDNWRSELYKYK
KVVKIEPLGVAPTKAKRRVVQREKRAVGIGAMFLGFLGAAGSTMGAASMTLTVQARQLLSGIVQQQNNLLRAIEAQQHL
LQLTVWGIKQLQARVLAVERYLKDQQLLGIWGCSGKLICTTAVPWNASWSNKSLDEIWDNMTWMEWEREIDNYTSLIYT
LIEESQNQQEKNEQELLELDKWASLWNWFDITNWLWYIKIFIMIVGGLVGLRIVFAVLSIVNRVRQGYSPLSFQTRLPA
PRGPDRPEGIEEEGGERDRDRSGRLVDGFLALIWDDLRSLCLFSYHRLRDLLLIVTRIVELLGRRGWEVLKYWWNLLQY
WSQELKNSAVSLLNATAIAVAEGTDRVIEVVQRACRAILHIPRRIRQGLERALL

CONSENSUS_B D113C/E429GCG SOSIP (SEQ ID NO: 40):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQGCGVGKAMYAPPIRGQIRCSSNITGLLLTRDGGNNETEIFRPGGGDMRDNWRSELYKYK
VVKIEPLGVAPTKCKRRVVQREKRAVGIGAMFLGFLGAAGSTMGAASMTLTVQARQLLSGIVQQQNNLLRAPEAQQHLL
QLTVWGIKQLQARVLAVERYLKDQQLLGIWGCSGKLICCTAVPWNASWSNKSLDEIWDNMTWMEWEREIDNYTSLIYTL
IEESQNQQEKNEQELLELD

CONSENSUS_B D113C/G431GCG SOSIP (SEQ ID NO: 41):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQEVGCGKAMYAPPIRGQIRCSSNITGLLLTRDGGNNETEIFRPGGGDMRDNWRSELYKYK
VVKIEPLGVAPTKCRRVVQREKRAVGIGAMFLGFLGAAGSTMGAASMTLTVQARQLLSGIVQQQNNLLRAPEAQQHLL
QLTVWGIKQLQARVLAVERYLKDQQLLGIWGCSGKLICCTAVPWNASWSNKSLDEIWDNMTWMEWEREIDNYTSLIYTL
IEESQNQQEKNEQELLELD

CONSENSUS_B D113C/K432GCG SOSIP (SEQ ID NO: 93):
MRVKGIRKNYQHLWRWGTMLLGMLMICSAAEKLWVTVYYGVPVWKEATTTLFCASDAKAYDTEVHNVWATHACVPTDPN
PQEVVLENVTENFNMWKNNMVEQMHEDIISLWCQSLKPCVKLTPLCVTLNCTDLMNATNTNTTIIYRWRGEIKNCSFNI
TTSIRDKVQKEYALFYKLDVVPIDNDNTSYRLISCNTSVITQACPKVSFEPIPIHYCAPAGFAILKCNDKKFNGTGPCT
NVSTVQCTHGIRPVVSTQLLLNGSLAEEEVVIRSENFTDNAKTIIVQLNESVEINCTRPNNNTRKSIHIGPGRAFYTTG
EIIGDIRQAHCNISRAKWNNTLKQIVKKLREQFGNKTIVFNQSSGGDPEIVMHSFNCGGEFFYCNTTQLFNSTWNGTWN
NTEGNITLPCRIKQIINMWQEVGKGCGAMYAPPIRGQIRCSSNITGLLLTRDGGNNETEIFRPGGGDMRDNWRSELYKY
KVVKIEPLGVAPTKCKRRVVQREKRAVGIGAMFLGFLGAAGSTMGAASMTLTVQARQLLSGIVQQQNNLLRAPEAQQHL
LQLTVWGIKQLQARVLAVERYLKDQQLLGIWGCSGKLICCTAVPWNASWSNKSLDEIWDNMTWMEWEREIDNYTSLIYT
LIEESQNQQEKNEQELLELD

CONSENSUS_C D113C/E429GCG gp160 (SEQ ID NO: 42):
MRVRGILRNCQQWWIWGILGFWMLMICNVVGNLWVTVYYGVPVWKEATTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQGCGVGRAMYAPPIAGNITCKSNITGLLLTRDGGKNNTETFRPGGGDMRDNWRSELYKYKVVEIKPLGIAPTK
AKRRVVEREKRAVGIGAVFLGFLGAAGSTMGAASITLTVQARQLLSGIVQQQSNLLRAIEAQQHMLQLTVWGIKQLQTR
VLAIERYLKDQLLGIWGCSGKLICTTAVPWNSSWSNKSQEDIWDNMTWMQWDREISNYTDTIYRLLEDSQNQQEKNEK
DLLALDSWKNLWNWFDITNWLWYIKIFIMIVGGLIGLRIIFAVLSIVNRVRQGYSPLSFQTLTPNPRGPDRLGRIEEEG
GEQDRDRSIRLVSGFLALAWDDLRSLCLFSYHRLRDFILIAARAVELLGRSSLRGLQRGWEALKYLGSLVQYWGLELKK
SAISLLDTIAIAVAEGTDRIIELIQRICRAIRNIPRRIRQGFEAALQ

CONSENSUS_C D113C/G431GCG gp160 (SEQ ID NO: 43):
MRVRGILRNCQQWWIWGILGFWMLMICNVVGNLWVTVYYGVPVWKEATTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK

TABLE 2-continued

Exemplary gp160 and gp140 proteins (with SOSIP mutations) with α1/β20-β21 stabilizing
disulfide bonds. HXB2 positions 113 and 332, 429 substitutions, insertions between
431/432, SOSIP substitutions, are shown in bold underline.

```
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQEVGCGRAMYAPPIAGNITCKSNITGLLLTRDGGKNNTETFRPGGGDMRDNWRSELYKYKVVEIKPLGIAPTK
AKRRVVEREKRAVGIGAVFLGFLGAAGSTMGAASITLTVQARQLLSGIVQQQSNLLRAIEAQQHMLQLTVWGIKQLQTR
VLAIERYLKDQQLLGIWGCSGKLICTTAVPWNSSWSNKSQEDIWDNMTWMQWDREISNYTDTIYRLLEDSQNQQEKNEK
DLLALDSWKNLWNWFDITNWLWYIKIFIMIVGGLIGLRIIFAVLSIVNRVRQGYSPLSFQTLTPNPRGPDRLGRIEEEG
GEQDRDRSIRLVSGFLALAWDDLRSLCLFSYHRLRDFILIAARAVELLGRSSLRGLQRGWEALKYLGSLVQYWGLELKK
SAISLLDTIAIAVAEGTDRIIELIQRICRAIRNIPRRIRQGFEAALQ

CONSENSUS_C D113C/R432GCG gp160 (SEQ ID NO: 94):
MRVRGILRNCQQWWIWGILGFWMLMICNVVGNLWVTVYYGVPVWKEAKTTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQEVGRGCGAMYAPPIAGNITCKSNITGLLLTRDGGKNNTETFRPGGGDMRDNWRSELYKYKVVEIKPLGIAPT
KAKRRVVEREKRAVGIGAVFLGFLGAAGSTMGAASITLTVQARQLLSGIVQQQSNLLRAIEAQQHMLQLTVWGIKQLQT
RVLAIERYLKDQQLLGIWGCSGKLICTTAVPWNSSWSNKSQEDIWDNMTWMQWDREISNYTDTIYRLLEDSQNQQEKNE
KDLLALDSWKNLWNWFDITNWLWYIKIFIMIVGGLIGLRIIFAVLSIVNRVRQGYSPLSFQTLTPNPRGPDRLGRIEEE
GGEQDRDRSIRLVSGFLALAWDDLRSLCLFSYHRLRDFILIAARAVELLGRSSLRGLQRGWEALKYLGSLVQYWGLELK
KSAISLLDTIAIAVAEGTDRIIELIQRICRAIRNIPRRIRQGFEAALQ

CONSENSUS_C D113C/E429GCG SOSIP (SEQ ID NO: 44):
MRVRGILRNCQQWWIWGILGFWMLMICNVVGNLWVTVYYGVPVWKEAKTTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQEVGCGVGRAMYAPPIAGNITCKSNITGLLLTRDGGKNNTETFRPGGGDMRDNWRSELYKYKVVEIKPLGIAPTK
CKRRVVEREKRAVGIGAVFLGFLGAAGSTMGAASITLTVQARQLLSGIVQQQSNLLRAPEAQQHMLQLTVWGIKQLQTR
VLAIERYLKDQQLLGIWGCSGKLICCTAVPWNSSWSNKSQEDIWDNMTWMQWDREISNYTDTIYRLLEDSQNQQEKNEK
DLLALD

CONSENSUS_C D113C/G431GCG SOSIP (SEQ ID NO: 45):
MRVRGILRNCQQWWIWGILGFWMLMICNVVGNLWVTVYYGVPVWKEAKTTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQEVGCGRAMYAPPIAGNITCKSNITGLLLTRDGGKNNTETFRPGGGDMRDNWRSELYKYKVVEIKPLGIAPTK
CKRRVVEREKRAVGIGAVFLGFLGAAGSTMGAASITLTVQARQLLSGIVQQQSNLLRAPEAQQHMLQLTVWGIKQLQTR
VLAIERYLKDQQLLGIWGCSGKLICCTAVPWNSSWSNKSQEDIWDNMTWMQWDREISNYTDTIYRLLEDSQNQQEKNEK
DLLALD

CONSENSUS_C D113C/R432GCG SOSIP (SEQ ID NO: 95):
MRVRGILRNCQQWWIWGILGFWMLMICNVVGNLWVTVYYGVPVWKEAKTTLFCASDAKAYEKEVHNVWATHACVPTDPN
PQEIVLENVTENFNMWKNDMVDQMHEDIISLWCQSLKPCVKLTPLCVTLNCTNATNATNTMGEIKNCSFNITTELRDKK
QKVYALFYRLDIVPLNENNSYRLINCNTSAITQACPKVSFDPIPIHYCAPAGYAILKCNNKTFNGTGPCNNVSTVQCTH
GIKPVVSTQLLLNGSLAEEEIIIRSENLTNNAKTIIVHLNESVEIVCTRPNNNTRKSIRIGPGQTFYATGDIIGDIRQA
HCNISEDKWNKTLQKVSKKLKEHFPNKTIKFEPSSGGDLEITTHSFNCRGEFFYCNTSKLFNSTYNSTNSTITLPCRIK
QIINMWQEVGRGCGAMYAPPIAGNITCKSNITGLLLTRDGGKNNTETFRPGGGDMRDNWRSELYKYKVVEIKPLGIAPT
KCKRRVVEREKRAVGIGAVFLGFLGAAGSTMGAASITLTVQARQLLSGIVQQQSNLLRAPEAQQHMLQLTVWGIKQLQT
RVLAIERYLKDQQLLGIWGCSGKLICCTAVPWNSSWSNKSQEDIWDNMTWMQWDREISNYTDTIYRLLEDSQNQQEKNE
KDLLALD

CONSENSUS_D D113C/G429GCG gp160 (SEQ ID NO: 46):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFPKSSGGDPEITTHSFNCGGEFFYCNTSRLFNSTWNNTKWNST
GKITLPCRIKQIINMWQGCGVGKAMYAPPIEGLIKCSSNITGLLLTRDGGANNSHNETFRPGGGDMRDNWRSELYKYKV
VKIEPLGVAPTRAKRRVVEREKRAIGLGAMFLGFLGAAGSTMGAASMTLTVQARQLLSGIVQQQNNLLRAIEAQQHLLQ
LTVWGIKQLQARILAVERYLKDQQLLGIWGCSGKHICTTTVPWNSSWSNKSLDEIWNNMTWMEWEREIDNYTGLIYSLI
EESSQNQQEKNEQELLELDKWASLWNWFSITQWLWYIKIFIMIVGGLIGLRIVFAVLSLVNRVRQGYSPLSFQTLLPAPR
GPDRPEGIEEEGGEQGRGRSIRLVNGFSALIWDDLRNLCLFSYHRLRDLILIAARIVELLGRRGWEALKYLWNLLQYWI
QELKNSAISLFDTTAIAVAEGTDRVIEIVQRACRAILNIPTRIRQGLERALL

CONSENSUS_D D113C/G431GCG gp160 (SEQ ID NO: 47):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFPKSSGGDPEITTHSFNCGGEFFYCNTSRLFNSTWNNTKWNST
GKITLPCRIKQIINMWQGVGCGKAMYAPPIEGLIKCSSNITGLLLTRDGGANNSHNETFRPGGGDMRDNWRSELYKYKV
```

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

VKIEPLGVAPTRAKRRVVEREKRAIGLGAMFLGFLGAAGSTMGAASMTLTVQARQLLSGIVQQQNNLLRAIEAQQHLLQ
LTVWGIKQLQARILAVERYLKDQQLLGIWGCSGKHICTTTVPWNSSWSNKSLDEIWNNMTWMEWEREIDNYTGLIYSLI
EESQNQQEKNEQELLELDKWASLWNWFSITQWLWYIKIFIMIVGGLIGLRIVFAVLSLVNRVRQGYSPLSFQTLLPAPR
GPDRPEGIEEEGGEQGRGRSIRLVNGFSALIWDDLRNLCLFSYHRLRDLILIAARIVELLGRRGWEALKYLWNLLQYWI
QELKNSAISLFDTTAIAVAEGTDRVIEIVQRACRAILNIPTRIRQGLERALL

CONSENSUS_D D113C/K432GCG gp160 (SEQ ID NO: 96):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFKPSSGGDPEITTHSFNCGGEFFYCNTSRLFNSTWNNTKWNST
GKITLPCRIKQIINMWQGVGKGCGAMYAPPIEGLIKCSSNITGLLLTRDGGANNSHNETFRPGGGDMRDNWRSELYKYK
VVKIEPLGVAPTRAKRRVVEREKRAIGLGAMFLGFLGAAGSTMGAASMTLTVQARQLLSGIVQQQNNLLRAIEAQQHLL
QLTVWGIKQLQARILAVERYLKDQQLLGIWGCSGKHICTTTVPWNSSWSNKSLDEIWNNMTWMEWEREIDNYTGLIYSL
IEESQNQQEKNEQELLELDKWASLWNWFSITQWLWYIKIFIMIVGGLIGLRIVFAVLSLVNRVRQGYSPLSFQTLLPAP
RGPDRPEGIEEEGGEQGRGRSIRLVNGFSALIWDDLRNLCLFSYHRLRDLILIAARIVELLGRRGWEALKYLWNLLQYW
IQELKNSAISLFDTTAIAVAEGTDRVIEIVQRACRAILNIPTRIRQGLERALL

CONSENSUS_D D113C/G429GCG SOSIP (SEQ ID NO: 48):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFKPSSGGDPEITTHSFNCGGEFFYCNTSRLFNSTWNNTKWNST
GKITLPCRIKQIINMWQGCGVGKAMYAPPIEGLIKCSSNITGLLLTRDGGANNSHNETFRPGGGDMRDNWRSELYKYKV
VKIEPLGVAPTRCKRRVVEREKRAIGLGAMFLGFLGAAGSTMGAASMTLTVQARQLLSGIVQQQNNLLRAPEAQQHLLQ
LTVWGIKQLQARILAVERYLKDQQLLGIWGCSGKHICCTTVPWNSSWSNKSLDEIWNNMTWMEWEREIDNYTGLIYSLI
EESQNQQEKNEQELLELD

CONSENSUS_D D113C/G431GCG SOSIP (SEQ ID NO: 49):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFKPSSGGDPEITTHSFNCGGEFFYCNTSRLFNSTWNNTKWNST
GKITLPCRIKQIINMWQGVGCGKAMYAPPIEGLIKCSSNITGLLLTRDGGANNSHNETFRPGGGDMRDNWRSELYKYKV
VKIEPLGVAPTRCKRRVVEREKRAIGLGAMFLGFLGAAGSTMGAASMTLTVQARQLLSGIVQQQNNLLRAPEAQQHLLQ
LTVWGIKQLQARILAVERYLKDQQLLGIWGCSGKHICCTTVPWNSSWSNKSLDEIWNNMTWMEWEREIDNYTGLIYSLI
EESQNQQEKNEQELLELD

CONSENSUS_D D113C/K432GCG SOSIP (SEQ ID NO: 97):
MRVRGIQRNYQHLWRWGIMLLGMLMICSVAENLWVTVYYGVPVWKEATTTLFCASDAKSYKTEAHNIWATHACVPTDPN
PQEIELENVTENFNMWKNNMVEQMHEDIISLWCQSLKPCVKLTPLCVTLNCTDVKRNNTSNDTNEGEMKNCSFNITTEI
RDKKKQVHALFYKLDVVPIDDNNSNTSYRLINCNTSAITQACPKVTFEPIPIHYCAPAGFAILKCKDKKFNGTGPCKNV
STVQCTHGIRPVVSTQLLLNGSLAEEEIIIRSENLTNNAKIIIVQLNESVTINCTRPYNNTRQRTPIGPGQALYTTRIK
GDIRQAHCNISRAEWNKTLQQVAKKLGDLLNKTTIIFKPSSGGDPEITTHSFNCGGEFFYCNTSRLFNSTWNNTKWNST
GKITLPCRIKQIINMWQGVGKGCGAMYAPPIEGLIKCSSNITGLLLTRDGGANNSHNETFRPGGGDMRDNWRSELYKYK
VVKIEPLGVAPTRCKRRVVEREKRAIGLGAMFLGFLGAAGSTMGAASMTLTVQARQLLSGIVQQQNNLLRAPEAQQHLL
QLTVWGIKQLQARILAVERYLKDQQLLGIWGCSGKHICCTTVPWNSSWSNKSLDEIWNNMTWMEWEREIDNYTGLIYSL
IEESQNQQEKNEQELLELD

CONSENSUS_F1 D113C/E429GCG gp160 (SEQ ID NO: 50):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQGCGVGRAMYAAPIAGNITCNSNITGLLLTRDGGQNNTETFRPGGGNMKDNWRSELYKYKVVEIEPLGV
APTKAKRQVVKRERRAVGIGAVFLGFLGAAGSTMGAASITLTVQARQLLSGIVQQQNNLLRAIEAQQHLLQLTVWGIKQ
LQARVLAVERYLKDQQLLGLWGCSGKLICTTNVPWNSSWSNKSQDEIWNNMTWMEWEKEISNYSNIIYRLIEESQNQQE
KNEQELLALDKWASLWNWFDISNWLWYIKIFIMIVGGLIGLRIVFAVLSIVNRVRKGYSPLSLQTLIPSPREPDRPEGI
EEGGGEQGKDRSVRLVNGFLALVWDDLRNLCLFSYRHLRDFILIAARIVDRGLRRGWEALKYLGNLTQYWSQELKNSAI
SLLNTTAIVVAEGTDRVIEALQRAGRAVLNIPRRIRQGLERALL

CONSENSUS_F1 D113C/G431GCG gp160 (SEQ ID NO: 51):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQEVGCGRAMYAAPIAGNITCNSNITGLLLTRDGGQNNTETFRPGGGNMKDNWRSELYKYKVVEIEPLGV
APTKAKRQVVKRERRAVGIGAVFLGFLGAAGSTMGAASITLTVQARQLLSGIVQQQNNLLRAIEAQQHLLQLTVWGIKQ
LQARVLAVERYLKDQQLLGLWGCSGKLICTTNVPWNSSWSNKSQDEIWNNMTWMEWEKEISNYSNIIYRLIEESQNQQE

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

KNEQELLALDKWASLWNWFDISNWLWYIKIFIMIVGGLIGLRIVFAVLSIVNRVRKGYSPLSLQTLIPSPREPDRPEGI
EEGGGEQGKDRSVRLVNGFLALVWDDLRNLCLFSYRHLRDFILIAARIVDRGLRRGWEALKYLGNLTQYWSQELKNSAI
SLLNTTAIVVAEGTDRVIEALQRAGRAVLNIPRRIRQGLERALL

CONSENSUS_F1 D113C/R432GCG gp160 (SEQ ID NO: 98):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQEVGRGCGAMYAAPIAGNITCNSNITGLLLTRDGGQNNTETFRPGGGNMKDNWRSELYKYKVVEIEPLG
VAPTKAKRQVVKRERRAVGIGAVFLGFLGAAGSTMGAASITLTVQARQLLSGIVQQQNNLLRAIEAQQHLLQLTVWGIK
QLQARVLAVERYLKDQQLLGLWGCSGKLICTTNVPWNSSWSNKSQDEIWNNMTWMEWEKEISNYSNIIYRLIEESQNQQ
EKNEQELLALDKWASLWNWFDISNWLWYIKIFIMIVGGLIGLRIVFAVLSIVNRVRKGYSPLSLQTLIPSPREPDRPEG
IEEGGGEQGKDRSVRLVNGFLALVWDDLRNLCLFSYRHLRDFILIAARIVDRGLRRGWEALKYLGNLTQYWSQELKNSA
ISLLNTTAIVVAEGTDRVIEALQRAGRAVLNIPRRIRQGLERALL

CONSENSUS_F1 D113C/E429GCG SOSIP (SEQ ID NO: 52):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQGCGVGRAMYAAPIAGNITCNSNITGLLLTRDGGQNNTETFRPGGGNMKDNWRSELYKYKVVEIEPLGV
APTKCKRQVVKRERRAVGIGAVFLGFLGAAGSTMGAASITLTVQARQLLSGIVQQQNNLLRAPEAQQHLLQLTVWGIKQ
LQARVLAVERYLKDQQLLGLWGCSGKLICCTNVPWNSSWSNKSQDEIWNNMTWMEWEKEISNYSNIIYRLIEESQNQQE
KNEQELLALD

CONSENSUS_F1 D113C/G431GCG SOSIP (SEQ ID NO: 53):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQEVGCGRAMYAAPIAGNITCNSNITGLLLTRDGGQNNTETFRPGGGNMKDNWRSELYKYKVVEIEPLGV
APTKCKRQVVKRERRAVGIGAVFLGFLGAAGSTMGAASITLTVQARQLLSGIVQQQNNLLRAPEAQQHLLQLTVWGIKQ
LQARVLAVERYLKDQQLLGLWGCSGKLICCTNVPWNSSWSNKSQDEIWNNMTWMEWEKEISNYSNIIYRLIEESQNQQE
KNEQELLALD

CONSENSUS_F1 D113C/R432GCG SOSIP (SEQ ID NO: 99):
MRVRGMQRNWQHLGKWGLLFLGILIICNAAENLWVTVYYGVPVWKEATTTLFCASDAKSYEKEVHNVWATHACVPTDPN
PQEVVLENVTENFDMWKNNMVEQMHTDIISLWCQSLKPCVKLTPLCVTLNCTDVNATNNDTNDNKTGAIQNCSFNMTTE
VRDKKLKVHALFYKLDIVPISNNNSKYRLINCNTSTITQACPKVSWDPIPIHYCAPAGYAILKCNDKRFNGTGPCKNVS
TVQCTHGIKPVVSTQLLLNGSLAEEDIIIRSQNISDNAKTIIVHLNESVQINCTRPNNNTRKSIHLGPGQAFYATGEII
GDIRKAHCNISGTQWNKTLEQVKAKLKSHFPNKTIKFNSSSGGDLEITMHSFNCRGEFFYCNTSGLFNDTGSNGTITLP
CRIKQIVNMWQEVGRGCGAMYAAPIAGNITCNSNITGLLLTRDGGQNNTETFRPGGGNMKDNWRSELYKYKVVEIEPLG
VAPTKCKRQVVKRERRAVGIGAVFLGFLGAAGSTMGAASITLTVQARQLLSGIVQQQNNLLRAPEAQQHLLQLTVWGIK
QLQARVLAVERYLKDQQLLGLWGCSGKLICCTNVPWNSSWSNKSQDEIWNNMTWMEWEKEISNYSNIIYRLIEESQNQQ
EKNEQELLALD

CONSENSUS_F2 D113C/R429GCG gp160 (SEQ ID NO: 54):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQGCGVGRAMYAPPIAGQIQCNSNITGLLLTRDGGKNGSETLRPGGGDMRDNWRSELYKYKVVKIEPLGVA
PTKAKRQVVQREKRAVGIGAVLLGFLGAAGSTMGAASITLTVQARQLLSGIVQQQSNLLKAIEAQQHLLQLTVWGIKQL
QARILAVERYLKDQQLLGIWGCSGKLICTTNVPWNSSWSNKSQDEIWDNMTWMQWEKEISNYTDTIYRLIEDAQNQQEK
NEQDLLALDKWDNLWSWFTITNWLWYIKIFIMIVGGLIGLRIVFAVLSVVNRVRQGYSPLSLQTLIPNPRGPERPGGIE
EEGGGEQDRDRSIRLVSGFLALAWDDLRSLCLFSYRHLRDFILIAARTVDMGLKRGWEALKYLWNLPQYWGQELKNSAIS
LLDTTAIAVAEGTDRIIEVLQRAGRAVLHIPRRIRQGFERALL

CONSENSUS_F2 D113C/G431GCG gp160 (SEQ ID NO: 55):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQRVCGRAMYAPPIAGQIQCNSNITGLLLTRDGGKNGSETLRPGGGDMRDNWRSELYKYKVVKIEPLGVA
PTKAKRQVVQREKRAVGIGAVLLGFLGAAGSTMGAASITLTVQARQLLSGIVQQQSNLLKAIEAQQHLLQLTVWGIKQL
QARILAVERYLKDQQLLGIWGCSGKLICTTNVPWNSSWSNKSQDEIWDNMTWMQWEKEISNYTDTIYRLIEDAQNQQEK
NEQDLLALDKWDNLWSWFTITNWLWYIKIFIMIVGGLIGLRIVFAVLSVVNRVRQGYSPLSLQTLIPNPRGPERPGGIE
EEGGGEQDRDRSIRLVSGFLALAWDDLRSLCLFSYRHLRDFILIAARTVDMGLKRGWEALKYLWNLPQYWGQELKNSAIS
LLDTTAIAVAEGTDRIIEVLQRAGRAVLHIPRRIRQGFERALL

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

CONSENSUS_F2 D113C/R432GCG gp160 (SEQ ID NO: 100):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQRVGRGCGAMYAPPIAGQIQCNSNITGLLLTRDGGKNGSETLRPGGGDMRDNWRSELYKYKVVKIEPLGV
APTKAKRQVVQREKRAVGIGAVLLGFLGAAGSTMGAASITLTVQARQLLSGIVQQQSNLLKAIEAQQHLLQLTVWGIKQ
LQARILAVERYLKDQQLLGIWGCSGKLICTTNVPWNSSWSNKSQDEIWDNMTWMQWEKEISNYTDTIYRLIEDAQNQQE
KNEQDLLALDKWDNLWSWFTITNWLWYIKIFIMIVGGLIGLRIVFAVLSVVNRVRQGYSPLSLQTLIPNPRGPERPGGI
EEEGGEQDRDRSIRLVSGFLALAWDDLRSLCLFSYRHLRDFILIAARTVDMGLKRGWEALKYLWNLPQYWGQELKNSAI
SLLDTTAIAVAEGTDRIIEVLQRAGRAVLHIPRRIRQGFERALL

CONSENSUS_F2 D113C/R429GCG SOSIP (SEQ ID NO: 56):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQGCGVGRAMYAPPIAGQIQCNSNITGLLLTRDGGKNGSETLRPGGGDMRDNWRSELYKYKVVKIEPLGVA
PTKCKRQVVQREKRAVGIGAVLLGFLGAAGSTMGAASITLTVQARQLLSGIVQQQSNLLKAPEAQQHLLQLTVWGIKQL
QARILAVERYLKDQQLLGIWGCSGKLICCTNVPWNSSWSNKSQDEIWDNMTWMQWEKEISNYTDTIYRLIEDAQNQQEK
NEQDLLALD

CONSENSUS_F2 D113C/G431GCG SOSIP (SEQ ID NO: 58):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQRVGCGRAMYAPPIAGQIQCNSNITGLLLTRDGGKNGSETLRPGGGDMRDNWRSELYKYKVVKIEPLGVA
PTKCKRQVVQREKRAVGIGAVLLGFLGAAGSTMGAASITLTVQARQLLSGIVQQQSNLLKAPEAQQHLLQLTVWGIKQL
QARILAVERYLKDQQLLGIWGCSGKLICCTNVPWNSSWSNKSQDEIWDNMTWMQWEKEISNYTDTIYRLIEDAQNQQEK
NEQDLLALD

CONSENSUS_F2 D113C/R432GCG SOSIP (SEQ ID NO: 101):
MRVREMQRNWQHLGKWGLLFLGILIICNAADNLWVTVYYGVPVWKEATTTLFCASDAKAYEREVHNVWATYACVPTDPS
PQELVLGNVTENFNMWKNNMVDQMHEDIISLWCQSLKPCVKLTPLCVTLNCTDVNVTINTTNVTLGEIKNCSFNITTEI
KDKKKKEYALFYRLDVVPINNSIVYRLISCNTSTVTQACPKVSFEPIPIHYCAPAGFAILKCNDKKFNGTGLCRNVSTV
QCTHGIRPVVSTQLLLNGSLAEEDIIIRSENISDNTKTIIVQFNRSVEINCTRPNNNTRKSIRIGPGRAFYATGDIIGD
IRKAYCNINRTLWNETLKKVAEEFKNHFNITVTFNPSSGGDLEITTHSFNCRGEFFYCNTSDLFNNTEVNNTKTITLPC
RIRQFVNMWQRVGRGCGAMYAPPIAGQIQCNSNITGLLLTRDGGKNGSETLRPGGGDMRDNWRSELYKYKVVKIEPLGV
APTKCKRQVVQREKRAVGIGAVLLGFLGAAGSTMGAASITLTVQARQLLSGIVQQQSNLLKAPEAQQHLLQLTVWGIKQ
LQARILAVERYLKDQQLLGIWGCSGKLICCTNVPWNSSWSNKSQDEIWDNMTWMQWEKEISNYTDTIYRLIEDAQNQQE
KNEQDLLALD

JRFL D113C/E429GCG gp160 (SEQ ID NO: 60):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQGCGVGKAMYAPPIRGQIRCSSNITGLLLTRDGGINENGTEIFRPGGGDMRDNWRS
ELYKYKVVKIEPLGVAPTKAKRRVVQREKRAVGIGAVFLGFLGAAGSTMGAASMTLTVQARLLLSGIVQQQNNLLRAIE
AQQRMLQLTVWGIKQLQARVLAVERYLGDQQLLGIWGCSGKLICTTAVPWNASWSNKSLDRIWNNMTWMEWEREIDNYT
SEIYTLIEESQNQQEKNEQELLELDKWASLWNWFDITKWLWYIKIFIMIVGGLVGLRLVFTVLSIVNRVRQGYSPLSFQ
TLLPAPRGPDRPEGIEEEGGERDRDRSGRLVNGFLALIWVDLRSLCLFSYHRLRDLLLTVTRIVELLGRRGWEVLKYWW
NLLQYWSQELKNSAVSLLNATAIAVAEGTDRIIEALQRTYRAILHIPTRIRQGLERALL

JRFL D113C/G431GCG gp160 (SEQ ID NO: 61):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQEVGCGKAMYAPPIRGQIRCSSNITGLLLTRDGGINENGTEIFRPGGGDMRDNWRS
ELYKYKVVKIEPLGVAPTKAKRRVVQREKRAVGIGAVFLGFLGAAGSTMGAASMTLTVQARLLLSGIVQQQNNLLRAIE
AQQRMLQLTVWGIKQLQARVLAVERYLGDQQLLGIWGCSGKLICTTAVPWNASWSNKSLDRIWNNMTWMEWEREIDNYT
SEIYTLIEESQNQQEKNEQELLELDKWASLWNWFDITKWLWYIKIFIMIVGGLVGLRLVFTVLSIVNRVRQGYSPLSFQ
TLLPAPRGPDRPEGIEEEGGERDRDRSGRLVNGFLALIWVDLRSLCLFSYHRLRDLLLTVTRIVELLGRRGWEVLKYWW
NLLQYWSQELKNSAVSLLNATAIAVAEGTDRIIEALQRTYRAILHIPTRIRQGLERALL

JRFL D113C/K432GCG gp160 (SEQ ID NO: 102):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQEVGKGCGAMYAPPIRGQIRCSSNITGLLLTRDGGINENGTEIFRPGGGDMRDNWR
SELYKYKVVKIEPLGVAPTKAKRRVVQREKRAVGIGAVFLGFLGAAGSTMGAASMTLTVQARLLLSGIVQQQNNLLRAI
EAQQRMLQLTVWGIKQLQARVLAVERYLGDQQLLGIWGCSGKLICTTAVPWNASWSNKSLDRIWNNMTWMEWEREIDNY
TSEIYTLIEESQNQQEKNEQELLELDKWASLWNWFDITKWLWYIKIFIMIVGGLVGLRLVFTVLSIVNRVRQGYSPLSF
QTLLPAPRGPDRPEGIEEEGGERDRDSGRLVNGFLALIWVDLRSLCLFSYHRLRDLLLTVTRIVELLGRRGWEVLKYW
WNLLQYWSQELKNSAVSLLNATAIAVAEGTDRIIEALQRTYRAILHIPTRIRQGLERALL

JRFL D113C/E429GCG SOSIP (SEQ ID NO: 62):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQGCGVGKAMYAPPIRGQIRCSSNITGLLLTRDGGINENGTEIFRPGGGDMRDNWRS
ELYKYKVVKIEPLGVAPTKCKRRVVQREKRAVGIGAVFLGFLGAAGSTMGAASMTLTVQARLLLSGIVQQQNNLLRAPE
AQQRMLQLTVWGIKQLQARVLAVERYLGDQQLLGIWGCSGKLICCTAVPWNASWSNKSLDRIWNNMTWMEWEREIDNYT
SEIYTLIEESQNQQEKNEQELLELD

JRFL D113C/G431GCG SOSIP (SEQ ID NO: 63):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQEVGCGKAMYAPPIRGQIRCSSNITGLLLTRDGGINENGTEIFRPGGGDMRDNWRS
ELYKYKVVKIEPLGVAPTKCKRRVVQREKRAVGIGAVFLGFLGAAGSTMGAASMTLTVQARLLLSGIVQQQNNLLRAPE
AQQRMLQLTVWGIKQLQARVLAVERYLGDQQLLGIWGCSGKLICCTAVPWNASWSNKSLDRIWNNMTWMEWEREIDNYT
SEIYTLIEESQNQQEKNEQELLELD

JRFL D113C/K432GCG SOSIP (SEQ ID NO: 103):
MRVKGIRKSYQYLWKGGTLLLGILMICSAVEKLWVTVYYGVPVWKEATTTLFCASDAKAYDTEVHNVWATHACVPTDPN
PQEVVLENVTEHFNMWKNNMVEQMQEDIISLWCQSLKPCVKLTPLCVTLNCKDVNATNTTNDSEGTMERGEIKNCSFNI
TTSIRDEVQKEYALFYKLDVVPIDNNNTSYRLISCDTSVITQACPKISFEPIPIHYCAPAGFAILKCNDKTFNGKGPCK
NVSTVQCTHGIRPVVSTQLLLNGSLAEEEVVIRSDNFTNNAKTIIVQLKESVEINCTRPNNNTRKSIHIGPGRAFYTTG
EIIGDIRQAHCNISRAKWNDTLKQIVIKLREQFENKTIVFNHSSGGDPEIVMHSFNCGGEFFYCNSTQLFNSTWNNNTE
GSNNTEGNTITLPCRIKQIINMWQEVGKGCGAMYAPPIRGQIRCSSNITGLLLTRDGGINENGTEIFRPGGGDMRDNWRS
ELYKYKVVKIEPLGVAPTKKCRRVVQREKRAVGIGAVFLGFLGAAGSTMGAASMTLTVQARLLLSGIVQQQNNLLRAP
EAQQRMLQLTVWGIKQLQARVLAVERYLGDQQLLGIWGCSGKLICCTAVPWNASWSNKSLDRIWNNMTWMEWEREIDNY
TSEIYTLIEESQNQQEKNEQELLELD

BaL D113C/K429GCG gp160 (SEQ ID NO: 64):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNNVTEESNNTVENNTITLPCRIKQIINMWQGCGVGRAMYAPPIRGQIRCSSNITGLLLTRDGGPEDNKTEVFRPGGG
DMRDNWRSELYKYKVVKIEPLGVAPTKAKRRVVQREKRAVGIGAVFLGFLGAAGSTMGAASMTLTVQARLLLSGIVQQQ
NNLLRAIEAQQHLLQLTVWGIKQLQARVLAVERYLRDQQLLGIWGCSGKLICTTAVPWNASWSNKSLNKIWDNMTWMEW
DREINNYTSIIYSLIEESQNQQEKNEQELLELDKWASLWNWFEITEWLWYIKIFIMIIGGLIGLRIVFSVLSIMNRVRQ
GYSPLSFQTHLPASRGPDRPGGIEEEGGERDRDSGRLVNGSLALIWDDLRSLCLFSYHRLRDLLLIVTRIVELLGRRG
WEALKYWWNLLQYWSQELKNSAVSLLNATAIAVAEGTDRVIEVVQGACRAIRHIPRRIRQGLERILL

BaL D113C/G431GCG gp160 (SEQ ID NO: 65):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNNVTEESNNTVENNTITLPCRIKQIINMWQKVGCGRAMYAPPIRGQIRCSSNITGLLLTRDGGPEDNKTEVFRPGGG
DMRDNWRSELYKYKVVKIEPLGVAPTKAKRRVVQREKRAVGIGAVFLGFLGAAGSTMGAASMTLTVQARLLLSGIVQQQ
NNLLRAIEAQQHLLQLTVWGIKQLQARVLAVERYLRDQQLLGIWGCSGKLICTTAVPWNASWSNKSLNKIWDNMTWMEW
DREINNYTSIIYSLIEESQNQQEKNEQELLELDKWASLWNWFEITEWLWYIKIFIMIIGGLIGLRIVFSVLSIMNRVRQ
GYSPLSFQTHLPASRGPDRPGGIEEEGGERDRDSGRLVNGSLALIWDDLRSLCLFSYHRLRDLLLIVTRIVELLGRRG
WEALKYWWNLLQYWSQELKNSAVSLLNATAIAVAEGTDRVIEVVQGACRAIRHIPRRIRQGLERILL

BaL D113C/R432GCG gp160 (SEQ ID NO: 104):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNNVTEESNNTVENNTITLPCRIKQIINMWQKVGRGCGAMYAPPIRGQIRCSSNITGLLLTRDGGPEDNKTEVFRPGGG
GDMRDNWRSELYKYKVVKIEPLGVAPTKAKRRVVQREKRAVGIGAVFLGFLGAAGSTMGAASMTLTVQARLLLSGIVQQ

TABLE 2-continued

Exemplary gp160 and gp140 proteins (with SOSIP mutations) with α1/β20-β21 stabilizing
disulfide bonds. HXB2 positions 113 and 332, 429 substitutions, insertions between
431/432, SOSIP substitutions, are shown in bold underline.

```
QNNLLRAIEAQQHLLQLTVWGIKQLQARVLAVERYLRDQQLLGIWGCSGKLICTTAVPWNASWSNKSLNKIWDNMTWME
WDREINNYTSIIYSLIEESQNQQEKNEQELLELDKWASLWNWFEITEWLWYIKIFIMIIGGLIGLRIVFSVLSIMNRVR
QGYSPLSFQTHLPASRGPDRPGGIEEEGGERDRDRSGRLVNGSLALIWDDLRSLCLFSYHRLRDLLLIVTRIVELLGRR
GWEALKYWWNLLQYWSQELKNSAVSLLNATAIAVAEGTDRVIEVVQGACRAIRHIPRRIRQGLERILL

BaL D113C/K429GCG SOSIP (SEQ ID NO: 66):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNVTEESNNTVENNTITLPCRIKQIINMWQGCGVGRAMYAPPIRGQIRCSSNITGLLLTRDGGPEDNKTEVFRPGGG
DMRDNWRSELYKYKVVKIEPLGVAPTKCKRRVVQREKRAVGIGAVFLGFLGAAGSTMGAASMTLTVQARLLLSGIVQQQ
NNLLRAPEAQQHLLQLTVWGIKQLQARVLAVERYLRDQQLLGIWGCSGKLICCTAVPWNASWSNKSLNKIWDNMTWMEW
DREINNYTSIIYSLIEESQNQQEKNEQELLELD

BaL D113C/G431GCG SOSIP (SEQ ID NO: 67):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNVTEESNNTVENNTITLPCRIKQIINMWQKVGCGRAMYAPPIRGQIRCSSNITGLLLTRDGGPEDNKTEVFRPGGG
DMRDNWRSELYKYKVVKIEPLGVAPTKCKRRVVQREKRAVGIGAVFLGFLGAAGSTMGAASMTLTVQARLLLSGIVQQQ
NNLLRAPEAQQHLLQLTVWGIKQLQARVLAVERYLRDQQLLGIWGCSGKLICCTAVPWNASWSNKSLNKIWDNMTWMEW
DREINNYTSIIYSLIEESQNQQEKNEQELLELD

BaL D113C/R432GCG SOSIP (SEQ ID NO: 105):
MRVKEKYQHLWRWGWRWGTMLLGMLMICSATEKLWVTVYYGVPVWKEATTTLFCASDAKAYDTEVHNVWATHACVPTDP
NPQEVELENVTENFNMWKNNMVEQMHEDIISLWCQSLKPCVKLTPLCVTLNCTDLRNATNGNDTNTTSSSREMMGGGEM
KNCSFKITTNIRGKVQKEYALFYKLDIVPIDNNSNNRYRLISCNTSVITQACPKISFEPIPIHYCAPAGFAILKCKDKK
FNGKGPCSNVSTVQCTHGIRPVVSTQLLLNGSLAEEEVVIRSENFADNAKTIIVQLNESVEINCTRPNNNTRKSIHIGP
GRALYTTGKIIGDIRQAHCNLSRAKWNDTLNKIVIKLREQFGNKTIVFKHSSGGDPEIVTHSFNCGGEFFYCNSTQLFN
STWNVTEESNNTVENNTITLPCRIKQIINMWQKVGRGCGAMYAPPIRGQIRCSSNITGLLLTRDGGPEDNKTEVFRPGG
GDMRDNWRSELYKYKVVKIEPLGVAPTKCKRRVVQREKRAVGIGAVFLGFLGAAGSTMGAASMTLTVQARLLLSGIVQQ
QNNLLRAPEAQQHLLQLTVWGIKQLQARVLAVERYLRDQQLLGIWGCSGKLICCTAVPWNASWSNKSLNKIWDNMTWME
WDREINNYTSIIYSLIEESQNQQEKNEQELLELD

NL4.3 D113C/K429GCG gp160 (SEQ ID NO: 68):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQGCGVGKAMYAPPISGQIRCSSNITGLLLTRDGGNNNNGSEIFRPGGGD
MRDNWRSELYKYKVVKIEPLGVAPTKAKRRVVQREKRAVGIGALFLGFLGAAGSTMGAASMTLTVQARQLLSDIVQQQN
NLLRAIEAQQHLLQLTVWGIKQLQARILAVERYLKDQQLLGIWGCSGKLICTTAVPWNASWSNKSLEQIWNNMTWMEWD
REINNYTSLIHSLIEESQNQQEKNEQELLELDKWASLWNWFNITNWLWYIKLFIMIVGGLVGLRIVPAVLSIVNRVRQG
YSPLSFQTHLPIPRGPDRPEGIEEEGGERDRDRSIRLVNGSLALIWDDLRSLCLFSYHRLRDLLLIVTRIVELLGRRGW
EALKYWWNLLQYWSQELKNSAVNLLNATAIAVAEGTDRVIEVLQAAYRAIRHIPRRIRQGLERILL

NL4.3 D113C/G431GCG gp160 (SEQ ID NO: 69):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQKVGCGRAMYAPPISGQIRCSSNITGLLLTRDGGNNNNGSEIFRPGGGD
MRDNWRSELYKYKVVKIEPLGVAPTKAKRRVVQREKRAVGIALFLGFLGAAGSTMGAASMTLTVQARQLLSDIVQQQN
NLLRAIEAQQHLLQLTVWGIKQLQARILAVERYLKDQQLLGIWGCSGKLICTTAVPWNASWSNKSLEQIWNNMTWMEWD
REINNYTSLIHSLIEESQNQQEKNEQELLELDKWASLWNWFNITNWLWYIKLFIMIVGGLVGLRIVPAVLSIVNRVRQG
YSPLSFQTHLPIPRGPDRPEGIEEEGGERDRDRSIRLVNGSLALIWDDLRSLCLFSYHRLRDLLLIVTRIVELLGRRGW
EALKYWWNLLQYWSQELKNSAVNLLNATAIAVAEGTDRVIEVLQAAYRAIRHIPRRIRQGLERILL

NL4.3 D113C/K432GCG gp160 (SEQ ID NO: 106):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQKVGGCGAMYAPPISGQIRCSSNITGLLLTRDGGNNNNGSEIFRPGGGD
MRDNWRSELYKYKVVKIEPLGVAPTKAKRRVVQREKRAVGIGALFLGFLGAAGSTMGAASMTLTVQARQLLSDIVQQQN
NLLRAIEAQQHLLQLTVWGIKQLQARILAVERYLKDQQLLGIWGCSGKLICTTAVPWNASWSNKSLEQIWNNMTWMEW
DREINNYTSLIHSLIEESQNQQEKNEQELLELDKWASLWNWFNITNWLWYIKLFIMIVGGLVGLRIVFAVLSIVNRVRQ
GYSPLSFQTHLPIPRGPDRPEGIEEEGGERDRDRSIRLVNGSLALIWDDLRSLCLFSYHRLRDLLLIVTRIVELLGRRG
WEALKYWWNLLQYWSQELKNSAVNLLNATAIAVAEGTDRVIEVLQAAYRAIRHIPRRIRQGLERILL
```

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

NL4.3 D113C/K429GCG SOSIP (SEQ ID NO: 70):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQGCGVGKAMYAPPISGQIRCSSNITGLLLTRDGGNNNNGSEIFRPGGGD
MRDNWRSELYKYKVVKIEPLGVAPTKCKRRVVQREKRAVGIGALFLGFLGAAGSTMGAASMTLTVQARQLLSDIVQQQN
NLLRAPEAQQHLLQLTVWGIKQLQARILAVERYLKDQQLLGIWGCSGKLICCTAVPWNASWSNKSLEQIWNNMTWMEWD
REINNYTSLIHSLIEESQNQQEKNEQELLELD

NL4.3 D113C/G431GCG SOSIP (SEQ ID NO: 71):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQKVGCGKAMYAPPISGQIRCSSNITGLLLTRDGGNNNNGSEIFRPGGGD
MRDNWRSELYKYKVVKIEPLGVAPTKCKRRVVQREKRAVGIGALFLGFLGAAGSTMGAASMTLTVQARQLLSDIVQQQN
NLLRAPEAQQHLLQLTVWGIKQLQARILAVERYLKDQQLLGIWGCSGKLICCTAVPWNASWSNKSLEQIWNNMTWMEWD
REINNYTSLIHSLIEESQNQQEKNEQELLELD

NL4.3 D113C/K432GCG SOSIP (SEQ ID NO: 107):
MRVKEKYQHLWRWGWKWGTMLLGILMICSATEKLWVTVYYGVPVWKEATTTLFCASDAKAYDTEVHNVWATHACVPTDP
NPQEVVLVNVTENFNMWKNDMVEQMHEDIISLWCQSLKPCVKLTPLCVSLKCTDLKNDTNTNSSSGRMIMEKGEIKNCS
FNISTSIRDKVQKEYAFFYKLDIVPIDNTSYRLISCNTSVITQACPKVSFEPIPIHYCAPAGFAILKCNNKTFNGTGPC
TNVSTVQCTHGIRPVVSTQLLLNGSLAEEDVVIRSANFTDNAKTIIVQLNTSVEINCTRPNNYTRKSIRIQRGPGRAFV
TIGKIGNMRQAHCNISRAKWNATLKQIASKLREQFGNNKTIIFKQSSGGDPEIVTHSFNCGGEFFYCNSTQLFNSTWFN
STWSTEGSNNTEGSDTITLPCRIKQFINMWQKVGGCGAMYAPPISGQIRCSSNITGLLLTRDGGNNNNGSEIFRPGGG
DMRDNWRSELYKYKVVKIEPLGVAPTKCKRRVVQREKRAVGIGALFLGFLGAAGSTMGAASMTLTVQARQLLSDIVQQQ
NNLLRAPEAQQHLLQLTVWGIKQLQARILAVERYLKDQQLLGIWGCSGKLICCTAVPWNASWSNKSLEQIWNNMTWMEW
DREINNYTSLIHSLIEESQNQQEKNEQELLELD

B41 D113C/E429GCG gp160 (SEQ ID NO: 72):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIIINMWQGCGVGKAMYAPPIRGQINCSSNITGLLLTRDGGE
SNKTIEVFRPGGGDMRDNWRSELYKYKVVKIEPLGVAPTKAKRRVVQREKRAVGLGALFVGFLGAAGSTMGAASITLTV
QARQLLSGIVQQQNNLLRAIEAQQHLLQLTVWGVKQLQARVLAVERYLKDQQLLGLWGCSGKLICTTAVPWNTSWSNKS
YDYIWDNMTWMQWEREIDNYTGVIYKLIEESQNQQEKNEQELLALDKWANLWNWFDITRWLWYIKIFIMIVGGLVGLRI
VFAVLSIVNRVRQGYSPLSLQTHFPAPRGPDRPEGTEEEGGDRDRDRSTPLVDGFLAIIWVDLRSLFLFSYHRLRDLLL
IVTRIVELLGRRGWEALKYWWNLLQYWSQELRNSAVSLFNATAIAVAEGTDRVIEAVQRIGRAILHIPRRIRQGFERAL
Q

B41 D113C/G431GCG gp160 (SEQ ID NO: 73):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQEVGCGKAMYAPPIRGQINCSSNITGLLLTRDGGE
SNKTIEVFRPGGGDMRDNWRSELYKYKVVKIEPLGVAPTKAKRRVVQREKRAVGLGALFVGFLGAAGSTMGAASITLTV
QARQLLSGIVQQQNNLLRAIEAQQHLLQLTVWGVKQLQARVLAVERYLKDQQLLGLWGCSGKLICTTAVPWNTSWSNKS
YDYIWDNMTWMQWEREIDNYTGVIYKLIEESQNQQEKNEQELLALDKWANLWNWFDITRWLWYIKIFIMIVGGLVGLRI
VFAVLSIVNRVRQGYSPLSLQTHFPAPRGPDRPEGTEEEGGDRDRDRSTPLVDGFLAIIWVDLRSLFLFSYHRLRDLLL
IVTRIVELLGRRGWEALKYWWNLLQYWSQELRNSAVSLFNATAIAVAEGTDRVIEAVQRIGRAILHIPRRIRQGFERAL
Q

B41 D113C/K432GCG gp160 (SEQ ID NO: 108):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQEVGKGCGAMYAPPIRGQINCSSNITGLLLTRDGG
ESNKTIEVFRPGGGDMRDNWRSELYKYKVVKIEPLGVAPTKAKRRVVQREKRAVGLGALFVGFLGAAGSTMGAASITLT
VQARQLLSGIVQQQNNLLRAIEAQQHLLQLTVWGVKQLQARVLAVERYLKDQQLLGLWGCSGKLICTTAVPWNTSWSNK
SYDYIWDNMTWMQWEREIDNYTGVIYKLIEESQNQQEKNEQELLALDKWANLWNWFDITRWLWYIKIFIMIVGGLVGLR
IVFAVLSIVNRVRQGYSPLSLQTHFPAPRGPDRPEGTEEEGGDRDRDRSTPLVDGFLAIIWVDLRSLFLFSYHRLRDLL
LIVTRIVELLGRRGWEALKYWWNLLQYWSQELRNSAVSLFNATAIAVAEGTDRVIEAVQRIGRAILHIPRRIRQGFERA
LQ

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

B41 D113C/E429GCG SOSIP (SEQ ID NO: 74):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQKEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQGCGVGKAMYAPPIRGQINCSSNITGLLLTRDGGE
SNKTIEVFRPGGGDMRDNWRSELYKYKVVKIEPLGVAPTKCKRRVVQREKRAVGLGALFVGFLGAAGSTMGAASITLTV
QARQLLSGIVQQQNNLLRAPEAQQHLLQLTVWGVKQLQARVLAVERYLKDQQLLGLWGCSGKLICCTAVPWNTSWSNKS
YDYIWDNMTWMQWEREIDNYTGVIYKLIEESQNQQEKNEQELLALD

B41 D113C/G431GCG SOSIP (SEQ ID NO: 75):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQKEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQEVGCGGKAMYAPPIRGQINCSSNITGLLLTRDGGE
SNKTIEVFRPGGGDMRDNWRSELYKYKVVKIEPLGVAPTKCKRRVVQREKRAVGLGALFVGFLGAAGSTMGAASITLTV
QARQLLSGIVQQQNNLLRAPEAQQHLLQLTVWGVKQLQARVLAVERYLKDQQLLGLWGCSGKLICCTAVPWNTSWSNKS
YDYIWDNMTWMQWEREIDNYTGVIYKLIEESQNQQEKNEQELLALD

B41 D113C/K432GCG SOSIP (SEQ ID NO: 109):
MRVRGIRKNCQCLWGWSNMMLLGILMICSVTGNLWVTVYYGVPVWKEANTTLFCASDAKGYDTEKHNVWATHACVPTDP
NPQEVLLGNNVTENFNMWKNNMVEQMHEDIISLWCQSLKPCVKLTPLCVTLNCTDLTKNSTTNNSTATNNTTNNSTEKM
EMDKGEMKNCSFNITTNIRDKMQKEYALLYKLDIVPIDNGKNNSNTNYRLISCNTSVITQSCPKVSFQPIPIHYCAPAG
FAILKCNNKTFNGSGPCTNVSSVQCTHGIRPVVSTQLLLNGSLAEEEIVIRSANFSDNTKTIIVQLKEAVEINCTRPNN
NTRKSINIGPGRAFYATGNIIGDIRQAHCNISRTKWNNTLTEIAKKLNKQYENRTIAFNQSSGGDLEIVMHSFNCGGEF
FYCNTSQLFRDTWNNTWNGIWNNDTEVNETITLPCRIKQIINMWQEVGKGCGAMYAPPIRGQINCSSNITGLLLTRDGG
ESNKTIEVFRPGGGDMRDNWRSELYKYKVVKIEPLGVAPTKCKRRVVQREKRAVGLGALFVGFLGAAGSTMGAASITLT
VQARQLLSGIVQQQNNLLRAPEAQQHLLQLTVWGVKQLQARVLAVERYLKDQQLLGLWGCSGKLICCTAVPWNTSWSNK
SYDYIWDNMTWMQWEREIDNYTGVIYKLIEESQNQQEKNEQELLALD

ZM197M E113C/R429GCG, D332N gp160 (SEQ ID NO: 76):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIIRSENLTDNKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQGCGVGRAMYASPIAGIITCKSNITGLLLTRDG
GNKSAGIETFRPGGGNMKDNWRSELYKYKVVEIKPLGIAPTSAKRRVVEREKRAAGIGAVILGFLGAAGSTMGAASVML
TVQARQLLSGIVQQQSNLLRAIEAQQHMLQLTVWGIKQLQTRVLAIERYLKDQQLLGLWGCSGKLICTTAVPWNTSWSN
KSKDEIWDNMTWMQWDREIDNYTQVIYQLLEVSQNQQEKNENDLLALDKWNSLWSWFDITKWLWYIKIFIMIVGGLIGL
RIIFAVLSVVNRVRQGYSPLSFQTLIPNPRGPDRPGGIEEEGGEQDKNRSTRLVSGFLALVWDDLRSLCLFSYHRLRDF
ILIAARAVELLGRSSLEGLQWGWETLKYLRNLVQYWGLELKQSAINLLDTIAIQVAEGTDRIIELIQRIFRAICNIPTR
IRQGFEAALQ

ZM197M E113C/G431GCG, D332N gp160 (SEQ ID NO: 77):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIIRSENLTDNKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQRVGCGGRAMYASPIAGIITCKSNITGLLLTRDG
GNKSAGIETFRPGGGNMKDNWRSELYKYKVVEIKPLGIAPTSAKRRVVEREKRAAGIGAVILGFLGAAGSTMGAASVML
TVQARQLLSGIVQQQSNLLRAIEAQQHMLQLTVWGIKQLQTRVLAIERYLKDQQLLGLWGCSGKLICTTAVPWNTSWSN
KSKDEIWDNMTWMQWDREIDNYTQVIYQLLEVSQNQQEKNENDLLALDKWNSLWSWFDITKWLWYIKIFIMIVGGLIGL
RIIFAVLSVVNRVRQGYSPLSFQTLIPNPRGPDRPGGIEEEGGEQDKNRSTRLVSGFLALVWDDLRSLCLFSYHRLRDF
ILIAARAVELLGRSSLEGLQWGWETLKYLRNLVQYWGLELKQSAINLLDTIAIQVAEGTDRIIELIQRIFRAICNIPTR
IRQGFEAALQ

ZM197M E113C/R432GCG, D332N gp160 (SEQ ID NO: 110):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIIRSENLTDNKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQRVGRGCGAMYASPIAGIITCKSNITGLLLTRD
GGNKSAGIETFRPGGGNMKDNWRSELYKYKVVEIKPLGIAPTSAKRRVVEREKRAAGIGAVILGFLGAAGSTMGAASVM
LTVQARQLLSGIVQQQSNLLRAIEAQQHMLQLTVWGIKQLQTRVLAIERYLKDQQLLGLWGCSGKLICTTAVPWNTSWS
NKSKDEIWDNMTWMQWDREIDNYTQVIYQLLEVSQNQQEKNENDLLALDKWNSLWSWFDITKWLWYIKIFIMIVGGLIG
LRIIFAVLSVVNRVRQGYSPLSFQTLIPNPRGPDRPGGIEEEGGEQDKNRSTRLVSGFLALVWDDLRSLCLFSYHRLRD
FILIAARAVELLGRSSLEGLQWGWETLKYLRNLVQYWGLELKQSAINLLDTIAIQVAEGTDRIIELIQRIFRAICNIPT
RIRQGFEAALQ

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

ZM197M E113C/R429GCG, D332N SOSIP (SEQ ID NO: 78):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIRSENLTDNTKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQGCGVGRAMYASPIAGIITCKSNITGLLLTRDG
GNKSAGIETFRPGGGNMKDNWRSELYKYKVVEIKPLGIAPTSCKRRVVEREKRAAGIGAVILGFLGAAGSTMGAASVML
TVQARQLLSGIVQQQSNLLRAPEAQQHMLQLTVWGIKQLQTRVLAIERYLKDQQLLGLWGCSGKLICCTAVPWNTSWSN
KSKDEIWDNMTWMQWDREIDNYTQVIYQLLEVSQNQQEKNENDLLALD

ZM197M E113C/G431GCG, D332N SOSIP (SEQ ID NO: 79):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIRSENLTDNTKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQRVGCGRAMYASPIAGIITCKSNITGLLLTRDG
GNKSAGIETFRPGGGNMKDNWRSELYKYKVVEIKPLGIAPTSCKRRVVEREKRAAGIGAVILGFLGAAGSTMGAASVML
TVQARQLLSGIVQQQSNLLRAPEAQQHMLQLTVWGIKQLQTRVLAIERYLKDQQLLGLWGCSGKLICCTAVPWNTSWSN
KSKDEIWDNMTWMQWDREIDNYTQVIYQLLEVSQNQQEKNENDLLALD

ZM197M E113C/R432GCG, D332N SOSIP (SEQ ID NO: 111):
MRVMGILRNWQQWWIWGILGFWMLMICNMEQLWVTVYYGVPVWKEAKATLFCASDAKAYEKEVHNVWATHACVPTDPNP
QEIPLGNVTENFNMWKNDMADQMHEDIISLWCQSLKPCVKLTPLCVTLNCSDATSNTTKNATNTNTTSTDNRNATSNDT
EMKGEIKDCTFNITTEVRDRKTKQRALFYKLDVVPLEEEKNSSSKNSSYKEYRLISCNTSTITQACPKVSFDPIPIHYC
APAGYAILKCNNKTFNGTGPCHNVSTVQCTHGIKPVVSTQLLLNGSLAEEEIIRSENLTDNTKTIIVHLNESVEIECV
RPNNNTRKSVRIGPGQTFFATGEIIGDIRQAHCNLSKSNWTTTLKRIEKKLKEHFNNATIKFESSAGGDLEITTHSFNC
RGEFFYCNTSGLFNSSLLNDTDGTSNSTSNATITLPCRIKQIINMWQRVGGCGAMYASPIAGIITCKSNITGLLLTRD
GGNKSAGIETFRPGGGNMKDNWRSELYKYKVVEIKPLGIAPTSCKRRVVEREKRAAGIGAVILGFLGAAGSTMGAASVM
LTVQARQLLSGIVQQQSNLLRAPEAQQHMLQLTVWGIKQLQTRVLAIERYLKDQQLLGLWGCSGKLICCTAVPWNTSWS
NKSKDEIWDNMTWMQWDREIDNYTQVIYQLLEVSQNQQEKNENDLLALD

DU422 D113C/E429GCG gp160 (SEQ ID NO: 80):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQGCGVGRAMYAPPIEGNITCKSNITGLLLTWDGGENSTEGVFRPGGGNMKD
NWRSELYKYKVVEIKPLGVAPTKSKRKVVGREKRAVGLGAVLLGFLGAAGSTMGAASITLTVQARQLLSGIVQQQSNLL
RAIEAQQHLLQLTVWGIKQLQTRVLAIERYLKDQQLLGLWGCSGKLICATAVPWNSSWSNKSLGDIWDNMTWMQWDREI
SNYTNTIFRLLEDSQNQQEKNEKDLLALDSWKNLWNWFDITNWLWYIKIFIMIVGGLIGLRIIFGVLAIVKRVRQGYSP
LSFQTLIPNPRGPDRLGRIEEEGGEQDKDRSIRLVSGFLALAWDDLRSLCLFSYHQLRDFILTAARAAELLGRSSLRGL
QRGWEVLKYLGNLVQYWGLELKRSAINLFDTIAIAVAEGTDRIIEVIQRICRAIRYIPTRIRQGFEAALL

DU422 D113C/G431GCG gp160 (SEQ ID NO: 81):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQEVGCGRAMYAPPIEGNITCKSNITGLLLTWDGGENSTEGVFRPGGGNMKD
NWRSELYKYKVVEIKPLGVAPTKSKRKVVGREKRAVGLGAVLLGFLGAAGSTMGAASITLTVQARQLLSGIVQQQSNLL
RAIEAQQHLLQLTVWGIKQLQTRVLAIERYLKDQQLLGLWGCSGKLICATAVPWNSSWSNKSLGDIWDNMTWMQWDREI
SNYTNTIFRLLEDSQNQQEKNEKDLLALDSWKNLWNWFDITNWLWYIKIFIMIVGGLIGLRIIFGVLAIVKRVRQGYSP
LSFQTLIPNPRGPDRLGRIEEEGGEQDKDRSIRLVSGFLALAWDDLRSLCLFSYHQLRDFILTAARAAELLGRSSLRGL
QRGWEVLKYLGNLVQYWGLELKRSAINLFDTIAIAVAEGTDRIIEVIQRICRAIRYIPTRIRQGFEAALL

DU422 D113C/R432GCG gp160 (SEQ ID NO: 112):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQEVGRGCGAMYAPPIEGNITCKSNITGLLLTWDGGENSTEGVFRPGGGNMK
DNWRSELYKYKVVEIKPLGVAPTKSKRKVVGREKRAVGLGAVLLGFLGAAGSTMGAASITLTVQARQLLSGIVQQQSNL
LRAIEAQQHLLQLTVWGIKQLQTRVLAIERYLKDQQLLGLWGCSGKLICATAVPWNSSWSNKSLGDIWDNMTWMQWDRE
ISNYTNTIFRLLEDSQNQQEKNEKDLLALDSWKNLWNWFDITNWLWYIKIFIMIVGGLIGLRIIFGVLAIVKRVRQGYS
PLSFQTLIPNPRGPDRLGRIEEEGGEQDKDRSIRLVSGFLALAWDDLRSLCLFSYHQLRDFILTAARAAELLGRSSLRG
LQRGWEVLKYLGNLVQYWGLELKRSAINLFDTIAIAVAEGTDRIIEVIQRICRAIRYIPTRIRQGFEAALL

DU422 D113C/E429GCG SOSIP (SEQ ID NO: 82):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT

TABLE 2-continued

Exemplary gp160 and gp140 proteins (with SOSIP mutations) with α1/β20-β21 stabilizing disulfide bonds. HXB2 positions 113 and 332, 429 substitutions, insertions between 431/432, SOSIP substitutions, are shown in bold underline.

```
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQGCGVGRAMYAPPIEGNITCKSNITGLLLTWDGGENSTEGVFRPGGGNMKD
NWRSELYKYKVVEIKPLGVAPTKCKRKVVGREKRAVGLGAVLLGFLGAAGSTMGAASITLTVQARQLLSGIVQQQSNLL
RAPEAQQHLLQLTVWGIKQLQTRVLAIERYLKDQQLLGLWGCSGKLICCTAVPWNSSWSNKSLGDIWDNMTWMQWDREI
SNYTNTIFRLLEDSQNQQEKNEKDLLALD

DU422 D113C/G431GCG SOSIP (SEQ ID NO: 83):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQEVGCGRAMYAPPIEGNITCKSNITGLLLTWDGGENSTEGVFRPGGGNMKD
NWRSELYKYKVVEIKPLGVAPTKCKRKVVGREKRAVGLGAVLLGFLGAAGSTMGAASITLTVQARQLLSGIVQQQSNLL
RAPEAQQHLLQLTVWGIKQLQTRVLAIERYLKDQQLLGLWGCSGKLICCTAVPWNSSWSNKSLGDIWDNMTWMQWDREI
SNYTNTIFRLLEDSQNQQEKNEKDLLALD

DU422 D113C/R432GCG SOSIP (SEQ ID NO: 113):
MRVRGIPRNWPQWWIWGILGFWMIIICRVVGNLDLWVTVYYGVPVWKEAKTTLFCASDAKAYDKEVHNVWATHACVPTD
PNPQEIVLENVTENFNMWKNDMVDQMHEDIISLWCQSLKPCVKLTPLCVTLNCKNVNISANANATATLNSSMNGEIKNC
SFNTTTELRDKKQKVYALFYKPDVVPLNGGEHNETGEYILINCNSSTITQACPKVSFDPIPIHYCAPAGYAILKCNNKT
FNGTGPCNNVSTVQCTHGIKPVVSTQLLLNGSLAEEEIIVRSENLTNNIKTIIVHLNKSVEIKCTRPNNNTRKSVRIGP
GQTFYATGEIIGDIREAHCNISRETWNSTLIQVKEKLREHYNKTIKFEPSSGGDLEVTTHSFNCRGEFFYCDTTKLFNE
TKLFNESEYVDNKTIILPCRIKQIINMWQEVGRGCGAMYAPPIEGNITCKSNITGLLLTWDGGENSTEGVFRPGGGNMK
DNWRSELYKYKVVEIKPLGVAPTKCKRKVVGREKRAVGLGAVLLGFLGAAGSTMGAASITLTVQARQLLSGIVQQQSNL
LRAPEAQQHLLQLTVWGIKQLQTRVLAIERYLKDQQLLGLWGCSGKLICCTAVPWNSSWSNKSLGDIWDNMTWMQWDRE
ISNYTNTIFRLLEDSQNQQEKNEKDLLALD
```

Any of the sequences listed in the preceding table can further comprise 201C-433C substitutions to introduce a non-native disulfide bond. Any of the sequences listed in the preceding table can comprise an I109C mutation instead of a D113C mutation. Any of the sequences listed in the preceding table can comprise an I109C mutation instead of a D113C mutation, and ca further comprise 201C-433C substitutions to introduce a non-native disulfide bond. Any of the sequences listed in the preceding table can comprise an I108C mutation instead of a D113C mutation. Any of the sequences listed in the preceding table can comprise an I108C mutation instead of a D113C mutation, and ca further comprise 201C-433C substitutions to introduce a non-native disulfide bond.

Single Chain HIV-1 Env proteins

In some embodiments, the HIV-1 Env ectodomain trimer including the recombinant gp120 protein can be made of three single chain HIV-1 Env ectodomains, which each include a single polypeptide chain including the gp120 polypeptide and the gp41 ectodomain. Native HIV-1 Env sequences include a furin cleavage site at position 511 (e.g., REKR$_{511}$, SEQ ID NO: 117), which is cleaved by a cellular protease to generate the gp120 and gp41 polypeptides. The single chain proteins do not include the furin cleavage site separating the gp120 and gp41 polypeptides; therefore, when produced in cells, the Env polypeptide is not cleaved into separate gp120 and gp41 polypeptides.

Single chain HIV-1 Env ectodomains can be generated by mutating the furin cleavage site to prevent cleave and formation of separate gp120 and gp41 polypeptide chains. In several embodiments, the gp120 and gp41 polypeptides in the single chain HIV-1 Env ectodomains are joined by a linker, such as a peptide linker. Examples of peptide linkers that can be used include glycine, serine, and glycine-serine linkers. In some embodiments, the peptide liker can comprise a 10 amino acid glycine-serine peptide linker, such as a peptide linker comprising the amino acid sequence set forth as SEQ ID NO: 16 (GGSGGGGSGG). In some embodiments, the single chain HIV-1 Env ectodomains can include a heterologous peptide linker between one of HIV-1 Env residues 507 and 512, 503 and 519, 504 and 519, 503 and 522, or 504 and 522. In some embodiments, the HIV-1 Env ectodomain trimer including the recombinant gp120 protein as disclosed herein can include three single chain HIV-1 Env ectodomains each comprising a heterologous peptide linker (such as a 10 amino acid glycine serine linker) between HIV-1 Env residues 507 and 512.

Any of the stabilizing mutations (or combinations thereof) disclosed herein can be included in the single chain HIV-1 Env ectodomain as long as the single chain HIV-1 Env ectodomain retains the desired properties (e.g., the HIV-1 Env prefusion mature closed conformation).

Membrane Anchored Embodiments

In some embodiments, the HIV-1 Env ectodomain trimer including the recombinant gp120 protein can be a membrane anchored HIV-1 Env ectodomain trimer, for example, the HIV-1 Env ectodomains in the trimer can each be linked to a transmembrane domain. The transmembrane domain can be linked to any portion of the HIV-1 Env ectodomain, as long as the presence of the transmembrane domain does not disrupt the structure of the HIV-1 Env ectodomain, or its ability to induce an immune response to HIV-1. In non-limiting examples, the transmembrane domain can be linked to the N- or C-terminal residue of a gp120 polypeptide, or the C-terminal residue of a gp41 ectodomain included in the HIV-1 Env ectodomain. One or more peptide linkers (such as a gly-ser linker, for example, a 10 amino acid glycine-serine peptide linker, such as a peptide linker comprising the amino acid sequence set forth as SEQ ID NO: 16 (GGSGGGGSGG) can be used to link the transmembrane domain and the gp120 or gp41 protein. In some embodiments a native HIV-1 Env MPER sequence can be used to link the transmembrane domain and the gp120 or gp41 protein.

Non-limiting examples of transmembrane domains for use with the disclosed embodiments include the BG505 TM domain (KIFIMIVGGLIGLRIVFAVLSVIHRVR, SEQ ID NO: 18), the Influenza A Hemagglutinin TM domain (ILAIYSTVASSLVLLVSLGAISF, SEQ ID NO: 19), and the Influenza A Neuraminidase TM domain (IITIGSICMVVGIISLILQIGNIISIWVS, SEQ ID NO: 20).

The recombinant HIV-1 Env ectodomain linked to the transmembrane domain can include any of the stabilizing mutations provided herein (or combinations thereof) as long as the recombinant HIV-1 Env ectodomain linked to the transmembrane domain retains the desired properties (e.g., the HIV-1 Env prefusion mature closed conformation).

Linkage to a Trimerization Domain

In several embodiments, the HIV-1 Env ectodomain trimer including the recombinant gp120 protein can be linked to a trimerization domain, for example, the C-terminus of the gp41 ectodomains included in the HIV-1 Env ectodomain trimer can be linked to the trimerization domain. The trimerization domain can promote trimerization of the three protomers of the recombinant HIV-1 Env protein. Non-limiting examples of exogenous multimerization domains that promote stable trimers of soluble recombinant proteins include: the GCN4 leucine zipper (Harbury et al. 1993 *Science* 262:1401-1407), the trimerization motif from the lung surfactant protein (Hoppe et al. 1994 FEBS *Lett* 344:191-195), collagen (McAlinden et al. 2003 *J Biol Chem* 278:42200-42207), and the phage T4 fibritin Foldon (Miroshnikov et al. 1998 *Protein Eng* 11:329-414), any of which can be linked to the recombinant HIV-1 Env ectodomain (e.g., by linkage to the C-terminus of the gp41 polypeptide to promote trimerization of the recombinant HIV-1 protein, as long as the recombinant HIV-1 Env ectodomain retains specific binding activity for a mature closed conformation specific antibody, prefusion-specific antibody (e.g., PGT122), and/or includes a HIV-1 Env mature closed conformation.

In some examples, the recombinant HIV-1 Env ectodomain can be linked to a T4 fibritin Foldon domain, for example, the recombinant HIV-1 Env ectodomain can include a gp41 polypeptide with a Foldon domain linked to its C-terminus. In specific examples, the T4 fibritin Foldon domain can include the amino acid sequence GYIPEAPRDGQAYVRKDGEWVLLSTF (SEQ ID NO: 21), which adopts a β-propeller conformation, and can fold and trimerize in an autonomous way (Tao et al. 1997 *Structure* 5:789-798).

Typically, the heterologous trimerization domain is positioned C-terminal to the gp41 protein. Optionally, the heterologous trimerization is connected to the recombinant HIV-1 Env ectodomain via a linker, such as an amino acid linker Exemplary linkers include Gly or Gly-Ser linkers, such as SEQ ID NO: 16 (GGSGGGGSGG). Some embodiments include a protease cleavage site for removing the trimerization domain from the HIV-1 polypeptide, such as, but not limited to, a thrombin site between the recombinant HIV-1 Env ectodomain and the trimerization domain.

B. Polynucleotides and Expression

Polynucleotides encoding a disclosed immunogen (e.g., a recombinant gp120 protein or a HIV-1 Env ectodomain trimer comprising the recombinant gp120 protein) are also provided. These polynucleotides include DNA, cDNA and RNA sequences which encode the antigen. One of skill in the art can readily use the genetic code to construct a variety of functionally equivalent nucleic acids, such as nucleic acids which differ in sequence but which encode the same amino acid sequence, or encode a conjugate or fusion protein including the nucleic acid sequence. Exemplary nucleic acid sequences for BG505-based constructs are provided below:

```
BG505 Wild-Type SOSIP (SEQ ID NO: 114):
ATGGACGCTATGAAAAGGGGGCTGTGCTGTGTGCTGCTGCTGTGCGGGGC

TGTGTTTGTGTCACCCAGTCAGGAAATCCACGCCAGATTCCGGAGAGGAG

CTAGGGCAGAAAACCTGTGGGTGACAGTCTACTATGGCGTGCCTGTCTGG

AAGGACGCCGAGACCACACTGTTTTGCGCTTCCGATGCCAAGGCTTACGA

AACTGAGAAACACAATGTGTGGGCTACCCATGCATGTGTCCCAACAGACC

CAAACCCCCAGGAAATCCACCTGGAGAATGTGACCGAGGAATTCAACATG

TGGAAGAACAATATGGTGGAGCAGATGCATACAGACATCATTTCCCTGTG

GGATCAGTCTCTGAAGCCTTGCGTGAAACTGACCCCACTGTGCGTCACAC

TCCAGTGTACAAACGTGACTAACAATATCACCGACGATATGCGCGGAGAA

CTGAAGAATTGTTCTTTCAACATGACTACCGAGCTGAGGGACAAGAAACA

GAAAGTGTACAGTCTGTTTTATCGCCTGGATGTGGTCCAGATCAATGAAA

ACCAGGGGAATAGAAGTAACAATTCAAACAAGGAGTACAGGCTGATCAAT

TGCAACACCAGTGCCATTACACAGGCTTGTCCAAAAGTGTCATTTGAACC

TATCCCAATTCATTATTGCGCACCTGCCGGCTTCGCCATCCTGAAGTGTA

AAGATAAGAAGTTCAACGGCACTGGGCCCTGCCCTTCAGTGAGCACTGTC

CAGTGTACCCACGGGATTAAGCCTGTGGTCTCCACCCAGCTGCTGCTGAA

TGGATCTCTGGCCGAGGAAGAAGTGATGATCCGGTCTGAGAACATCACTA

ACAACGCTAAGAACATCCTGGTGCAGTTCAACACCCCCGTCCAGATTAAT

TGCACTAGACCTAACAATAACACCAGGAAATCTATCCGCATTGGACCCGG

CCAGGCCTTTTATGCTACCGGCGACATCATTGGGGATATCCGGCAGGCAC

ACTGTAATGTGAGCAAGGCTACATGGAACGAGACTCTGGGGAAGGTGGTC

AAACAGCTGCGCAAACATTTCGGAAATAACACCATCATTCGATTTGCCAA

TAGCTCCGGCGGGGACCTGGAAGTGACAACTCACAGCTTCAACTGCGGAG

GCGAGTTCTTTTACTGTAACACAAGTGGCCTGTTTAATTCAACTTGGATC

AGCAACACCTCCGTGCAGGGCTCTAATTCTACCGGCTCTAACGATAGTAT

CACACTGCCATGCCGGATTAAGCAGATCATTAATATGTGGCAGAGAATCG

GGCAGGCAATGTATGCCCCCCCTATCCAGGGAGTGATTCGATGTGTCAGC

AATATCACAGGCCTGATTCTGACTAGAGACGGGGGATCAACAAACAGCAC

CACAGAGACTTTCAGGCCCGGCGGGGAGACATGCGAGATAACTGGCGGT

CCGAACTGTACAAGTATAAAGTGGTCAAGATCGAGCCACTGGGAGTGGCA

CCAACCCGATGCAAAAGGCGAGTGGTCGGACGACGAAGAAGGCGACGAGC

TGTGGGATTGGAGCAGTCTTCCTGGGCTTTCTGGGGGCCGCTGGATCTA

CAATGGGCGCAGCCAGTATGACTCTGACCGTCCAGGCCAGGAATCTGCTG

TCAGGGATCGTGCAGCAGCAGAGCAACCTGCTGCGCGCTCCCGAAGCACA

GCAGCATCTGCTGAAGCTGACCGTGTGGGGCATCAAGCAGCTCCAGGCAC

GAGTGCTGGCAGTCGAGCGGTACCTGAGAGATCAGCAGCTGCTGGGAATC

TGGGGGTGCAGCGGAAAGCTGATTTGCTGTACCAATGTGCCTTGGAACTC

TAGTTGGAGCAATAGAAACCTGTCCGAAATCTGGGACAATATGACATGGC
```

TCCAGTGGGATAAGGAGATTAGCAACTACACTCAGATCATCTACGGCCTG
CTGGAAGAGTCCCAGAATCAGCAGGAGAAGAACGAGCAGGACCTGCTGG
CCTGGATTGA

BG505 D113C/R429GCG SOSIP (SEQ ID NO: 115):
ATGGACGCTATGAAAAGGGGGCTGTGCTGTGTGCTGCTGCTGTGCGGGGC
TGTGTTTGTGTCACCCAGTCAGGAAATCCACGCCAGATTCCGGAGAGGAG
CTAGGGCAGAAAACCTGTGGGTGACAGTCTACTATGGCGTGCCTGTCTGG
AAGGACGCCGAGACCACACTGTTTTGCGCTTCCGATGCCAAGGCTTACGA
AACTGAGAAACACAATGTGTGGGCTACCCATGCATGTGTCCCAACAGACC
CAAACCCCCAGGAAATCCACCTGGAGAATGTGACCGAGGAATTCAACATG
TGGAAGAACAATATGGTGGAGCAGATGCATACAGACATCATTTCCCTGTG
GTGCCAGTCTCTGAAGCCTTGCGTGAAACTGACCCCACTGTGCGTCACAC
TCCAGTGTACAAACGTGACTAACAATATCACCGACGATATGCGCGGAGAA
CTGAAGAATTGTTCTTTCAACATGACTACCGAGCTGAGGGACAAGAAACA
GAAAGTGTACAGTCTGTTTTATCGCCTGGATGTGGTCCAGATCAATGAAA
ACCAGGGGAATAGAAGTAACAATTCAAACAAGGAGTACAGGCTGATCAAT
TGCAACACCAGTGCCATTACACAGGCTTGTCCAAAAGTGTCATTTGAACC
TATCCCAATTCATTATTGCGCACCTGCCGGCTTCGCCATCCTGAAGTGTA
AAGATAAGAAGTTCAACGGCACTGGGCCCTGCCCTTCAGTGAGCACTGTC
CAGTGTACCCACGGGATTAAGCCTGTGGTCTCCACCCAGCTGCTGCTGAA
TGGATCTCTGGCCGAGGAAGAAGTGATGATCCGGTCTGAGAACATCACTA
ACAACGCTAAGAACATCCTGGTGCAGTTCAACACCCCCGTCCAGATTAAT
TGCACTAGACCTAACAATAACACCAGGAAATCTATCCGCATTGGACCCGG
CCAGGCCTTTTATGCTACCGGCGACATCATTGGGGATATCCGGCAGCAC
ACTGTAATGTGAGCAAGGCTACATGGAACGAGACTCTGGGGAAGGTGGTC
AAACAGCTGCGCAAACATTTCGGAAATAACACCATCATTCGATTTGCCAA
TAGCTCCGGCGGGGACCTGGAAGTGACAACTCACAGCTTCAACTGCGGAG
GCGAGTTCTTTTACTGTAACACAAGTGGCCTGTTTAATTCAACTTGGATC
AGCAACACCTCCGTGCAGGGCTCTAATTCTACCGGCTCTAACGATAGTAT
CACACTGCCATGCCGGATTAAGCAGATCATTAATATGTGGCAGGGCTGCG
GCATCGGGCAGGCAATGTATGCCCCCCCTATCCAGGGAGTGATTCGATGT
GTCAGCAATATCACAGGCCTGATTCTGACTAGAGACGGGGGATCAACAAA
CAGCACCACAGAGACTTTCAGGCCCGGCGGGGGAGACATGCGAGATAACT
GGCGGTCCGAACTGTACAAGTATAAAGTGGTCAAGATCGAGCCACTGGGA
GTGGCACCAACCCGATGCAAAAGGCGAGTGGTCGGACGACGAAGAAGGCG
ACGAGCTGTGGGGATTGGAGCAGTCTTCCTGGGCTTTCTGGGGGCCGCTG
GATCTACAATGGGCGCAGCCAGTATGACTCTGACCGTCCAGGCCAGGAAT
CTGCTGTCAGGGATCGTGCAGCAGCAGAGCAACCTGCTGCGCGCTCCCGA
AGCACAGCAGCATCTGCTGAAGCTGACCGTGTGGGGCATCAAGCAGCTCC
AGGCACGAGTGCTGGCAGTCGAGCGGTACCTGAGAGATCAGCAGCTGCTG
GGAATCTGGGGGTGCAGCGGAAAGCTGATTTGCTGTACCAATGTGCCTTG

GAACTCTAGTTGGAGCAATAGAAACCTGTCCGAAATCTGGGACAATATGA
CATGGCTCCAGTGGGATAAGGAGATTAGCAACTACACTCAGATCATCTAC
GGCCTGCTGGAAGAGTCCCAGAATCAGCAGGAGAAGAACGAGCAGGACCT
GCTGGCCCTGGATTGA

BG505 D113C/G431GCG SOSIP (SEQ ID NO: 116):
ATGGACGCTATGAAAAGGGGGCTGTGCTGTGTGCTGCTGCTGTGCGGGGC
TGTGTTTGTGTCACCCAGTCAGGAAATCCACGCCAGATTCCGGAGAGGAG
CTAGGGCAGAAAACCTGTGGGTGACAGTCTACTATGGCGTGCCTGTCTGG
AAGGACGCCGAGACCACACTGTTTTGCGCTTCCGATGCCAAGGCTTACGA
AACTGAGAAACACAATGTGTGGGCTACCCATGCATGTGTCCCAACAGACC
CAAACCCCCAGGAAATCCACCTGGAGAATGTGACCGAGGAATTCAACATG
TGGAAGAACAATATGGTGGAGCAGATGCATACAGACATCATTTCCCTGTG
GTGCCAGTCTCTGAAGCCTTGCGTGAAACTGACCCCACTGTGCGTCACAC
TCCAGTGTACAAACGTGACTAACAATATCACCGACGATATGCGCGGAGAA
CTGAAGAATTGTTCTTTCAACATGACTACCGAGCTGAGGGACAAGAAACA
GAAAGTGTACAGTCTGTTTTATCGCCTGGATGTGGTCCAGATCAATGAAA
ACCAGGGGAATAGAAGTAACAATTCAAACAAGGAGTACAGGCTGATCAAT
TGCAACACCAGTGCCATTACACAGGCTTGTCCAAAAGTGTCATTTGAACC
TATCCCAATTCATTATTGCGCACCTGCCGGCTTCGCCATCCTGAAGTGTA
AAGATAAGAAGTTCAACGGCACTGGGCCCTGCCCTTCAGTGAGCACTGTC
CAGTGTACCCACGGGATTAAGCCTGTGGTCTCCACCCAGCTGCTGCTGAA
TGGATCTCTGGCCGAGGAAGAAGTGATGATCCGGTCTGAGAACATCACTA
ACAACGCTAAGAACATCCTGGTGCAGTTCAACACCCCCGTCCAGATTAAT
TGCACTAGACCTAACAATAACACCAGGAAATCTATCCGCATTGGACCCGG
CCAGGCCTTTTATGCTACCGGCGACATCATTGGGGATATCCGGCAGCAC
ACTGTAATGTGAGCAAGGCTACATGGAACGAGACTCTGGGGAAGGTGGTC
AAACAGCTGCGCAAACATTTCGGAAATAACACCATCATTCGATTTGCCAA
TAGCTCCGGCGGGGACCTGGAAGTGACAACTCACAGCTTCAACTGCGGAG
GCGAGTTCTTTTACTGTAACACAAGTGGCCTGTTTAATTCAACTTGGATC
AGCAACACNTCCGTGCAGGGCTCTAATTCTACCGGCTCTAACGATAGTAT
CACACTGCCATGCCGGATTAAGCAGATCATTAATATGTGGCAGAGAATCG
GGTGCGGCCAGGCAATGTATGCCCCCCCTATCCAGGGAGTGATTCGATGT
GTCAGCAATATCACAGGCCTGATTCTGACTAGAGACGGGGGATCAACAAA
CAGCACCACAGAGACTTTCAGGCCCGGCGGGGGAGACATGCGAGATAACT
GGCGGTCCGAACTGTACAAGTATAAAGTGGTCAAGATCGAGCCACTGGGA
GTGGCACCAACCCGATGCAAAAGGCGAGTGGTCGGACGACGAAGAAGGCG
ACGAGCTGTGGGGATTGGAGCAGTCTTCCTGGGCTTTCTGGGGGCCGCTG
GATCTACAATGGGCGCAGCCAGTATGACTCTGACCGTCCAGGCCAGGAAT
CTGCTGTCAGGGATCGTGCAGCAGCAGAGCAACCTGCTGCGCGCTCCCGA
AGCACAGCAGCATCTGCTGAAGCTGACCGTGTGGGGCATCAAGCAGCTCC
AGGCACGAGTGCTGGCAGTCGAGCGGTACCTGAGAGATCAGCAGCTGCTG

-continued

```
GGAATCTGGGGGTGCAGCGGAAAGCTGATTTGCTGTACCAATGTGCCTTG

GAACTCTAGTTGGAGCAATAGAAACCTGTCCGAAATCTGGGACAATATGA

CATGGCTCCAGTGGGATAAGGAGATTAGCAACTACACTCAGATCATCTAC

GGCCTGCTGGAAGAGTCCCAGAATCAGCAGGAGAAGAACGAGCAGGACCT

GCTGGCCCTGGATTGA
```

In several embodiments, the nucleic acid molecule encodes a precursor of a disclosed recombinant HIV-1 Env ectodomain or immunogenic fragment thereof, that, when expressed in an appropriate cell, is processed into a disclosed recombinant HIV-1 Env ectodomain or immunogenic fragment thereof. For example, the nucleic acid molecule can encode a recombinant HIV-1 Env ectodomain including a N-terminal signal sequence for entry into the cellular secretory system that is proteolytically cleaved in the during processing of the HIV-1 Env protein in the cell. In some embodiments, the signal peptide includes the amino acid sequence set forth as residues 1-30 of SEQ ID NO: 2.

Exemplary nucleic acids can be prepared by cloning techniques. Examples of appropriate cloning and sequencing techniques, and instructions sufficient to direct persons of skill through many cloning exercises are known (see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013). Product information from manufacturers of biological reagents and experimental equipment also provide useful information. Such manufacturers include the SIGMA Chemical Company (Saint Louis, Mo.), R&D Systems (Minneapolis, Minn.), Pharmacia Amersham (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie AG, Buchs, Switzerland), Invitrogen (Carlsbad, Calif.), and Applied Biosystems (Foster City, Calif.), as well as many other commercial sources known to one of skill.

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

The polynucleotides encoding a disclosed immunogen (e.g., a recombinant gp120 protein or a HIV-1 Env ectodomain trimer comprising the recombinant gp120 protein) can include a recombinant DNA which is incorporated into a vector into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

Polynucleotide sequences encoding a disclosed immunogen (e.g., a recombinant gp120 protein or a HIV-1 Env ectodomain trimer comprising the recombinant gp120 protein) can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signal for introns, maintenance of the correct reading frame of that gene to permit proper translation of mRNA, and stop codons.

DNA sequences encoding the disclosed immunogen (e.g., a recombinant gp120 protein or a HIV-1 Env ectodomain trimer comprising the recombinant gp120 protein) can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Hosts can include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium,* SF9 cells, C129 cells, 293 cells, *Neurospora,* and immortalized mammalian myeloid and lymphoid cell lines. Techniques for the propagation of mammalian cells in culture are well-known (see, e.g., Helgason and Miller (Eds.), 2012, Basic Cell Culture Protocols (Methods in Molecular Biology), 4$^{th}$ Ed., Humana Press). Examples of commonly used mammalian host cell lines are VERO and HeLa cells, CHO cells, and WI38, BHK, and COS cell lines, although cell lines may be used, such as cells designed to provide higher expression, desirable glycosylation patterns, or other features. In some embodiments, the host cells include HEK293 cells or derivatives thereof, such as GnTI$^{-/-}$ cells (ATCC® No. CRL-3022), or HEK-293F cells.

Transformation of a host cell with recombinant DNA can be carried out by conventional techniques as are well known to those skilled in the art. Where the host is prokaryotic, such as, but not limited to, *E. coli,* competent cells which are capable of DNA uptake can be prepared from cells harvested after exponential growth phase and subsequently treated by the $CaCl_2$ method using procedures well known in the art. Alternatively, $MgCl_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Viral Expression Vectors, Springer press, Muzyczka ed., 2011). One of skill in the art can readily use an expression systems such as plasmids and vectors of use in producing proteins in cells including higher eukaryotic cells such as the COS, CHO, HeLa and myeloma cell lines.

In one non-limiting example, a disclosed immunogen is expressed using the pVRC8400 vector (described in Barouch et al., *J. Virol*, 79, 8828-8834, 2005, which is incorporated by reference herein).

Modifications can be made to a nucleic acid encoding a disclosed immunogen (e.g., a recombinant gp120 protein or a HIV-1 Env ectodomain trimer comprising the recombinant gp120 protein) without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps.

C. Viral Vectors

A nucleic acid molecule encoding a disclosed immunogen (e.g., a recombinant gp120 protein or a HIV-1 Env ectodomain trimer comprising the recombinant gp120 protein) can be included in a viral vector, for example, for expression of the immunogen in a host cell, or for immunization of a subject as disclosed herein. In some embodiments, the viral vectors are administered to a subject as part of a prime-boost vaccination. In several embodiments, the viral vectors are included in a vaccine, such as a primer vaccine or a booster vaccine for use in a prime-boost vaccination.

In several examples, the viral vector can be replication-competent. For example, the viral vector can have a mutation in the viral genome that does not inhibit viral replication in host cells. The viral vector also can be conditionally replication-competent. In other examples, the viral vector is replication-deficient in host cells.

A number of viral vectors have been constructed, that can be used to express the disclosed antigens, including polyoma, i.e., SV40 (Madzak et al., 1992, *J. Gen. Virol.*, 73:15331536), adenovirus (Berkner, 1992, *Cur. Top. Microbiol. Immunol.*, 158:39-6; Berliner et al., 1988, *Bio Techniques*, 6:616-629; Gorziglia et al., 1992, *J. Virol.*, 66:4407-4412; Quantin et al., 1992, *Proc. Natl. Acad. Sci. USA*, 89:2581-2584; Rosenfeld et al., 1992, *Cell*, 68:143-155; Wilkinson et al., 1992, *Nucl. Acids Res.*, 20:2233-2239; Stratford-Perricaudet et al., 1990, *Hum. Gene Ther.*, 1:241-256), vaccinia virus (Mackett et al., 1992, *Biotechnology*, 24:495-499), adeno-associated virus (Muzyczka, 1992, *Curr. Top. Microbiol. Immunol.*, 158:91-123; On et al., 1990, *Gene*, 89:279-282), herpes viruses including HSV and EBV (Margolskee, 1992, *Curr. Top. Microbiol. Immunol.*, 158: 67-90; Johnson et al., 1992, *J. Virol.*, 66:29522965; Fink et al., 1992, *Hum. Gene Ther.* 3:11-19; Breakfield et al., 1987, *Mol. Neurobiol.*, 1:337-371; Fresse et al., 1990, *Biochem. Pharmacol.*, 40:2189-2199), Sindbis viruses (H. Herweijer et al., 1995, *Human Gene Therapy* 6:1161-1167; U.S. Pat. Nos. 5,091,309 and 5,2217,879), alphaviruses (S. Schlesinger, 1993, *Trends Biotechnol.* 11:18-22; I. Frolov et al., 1996, *Proc. Natl. Acad. Sci.* USA 93:11371-11377) and retroviruses of avian (Brandyopadhyay et al., 1984, *Mol. Cell Biol.*, 4:749-754; Petropouplos et al., 1992, *J. Virol.*, 66:3391-3397), murine (Miller, 1992, *Curr. Top. Microbiol. Immunol.*, 158:1-24; Miller et al., 1985, *Mol. Cell Biol.*, 5:431-437; Sorge et al., 1984, *Mol. Cell Biol.*, 4:1730-1737; Mann et al., 1985, *J. Virol.*, 54:401-407), and human origin (Page et al., 1990, *J. Virol.*, 64:5370-5276; Buchschalcher et al., 1992, *J. Virol.*, 66:2731-2739). Baculovirus (Autographa californica multinuclear polyhedrosis virus; AcMNPV) vectors are also known in the art, and may be obtained from commercial sources (such as PharMingen, San Diego, Calif.; Protein Sciences Corp., Meriden, Conn.; Stratagene, La Jolla, Calif.).

In several embodiments, the viral vector can include an adenoviral vector that expresses a disclosed recombinant HIV-1 Env ectodomain or immunogenic fragment thereof. Adenovirus from various origins, subtypes, or mixture of subtypes can be used as the source of the viral genome for the adenoviral vector. Non-human adenovirus (e.g., simian, chimpanzee, gorilla, avian, canine, ovine, or bovine adenoviruses) can be used to generate the adenoviral vector. For example, a simian adenovirus can be used as the source of the viral genome of the adenoviral vector. A simian adenovirus can be of serotype 1, 3, 7, 11, 16, 18, 19, 20, 27, 33, 38, 39, 48, 49, 50, or any other simian adenoviral serotype. A simian adenovirus can be referred to by using any suitable abbreviation known in the art, such as, for example, SV, SAdV, SAV or sAV. In some examples, a simian adenoviral vector is a simian adenoviral vector of serotype 3, 7, 11, 16, 18, 19, 20, 27, 33, 38, or 39. In one example, a chimpanzee serotype C Ad3 vector is used (see, e.g., Peruzzi et al., *Vaccine*, 27:1293-1300, 2009). Human adenovirus can be used as the source of the viral genome for the adenoviral vector. Human adenovirus can be of various subgroups or serotypes. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22, 23, 24, 25, 26, 27, 28, 29, 30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serotype. Replication competent and deficient adenoviral vectors (including singly and multiply replication deficient adenoviral vectors) can be used with the disclosed embodiments. Examples of replication-deficient adenoviral vectors, including multiply replication-deficient adenoviral vectors, are disclosed in U.S. Patent Nos. 5,837,511; 5,851,806; 5,994,106; 6,127,175; 6,482,616; and 7,195,896, and International Patent Application Nos. WO 94/28152, WO 95/02697, WO 95/16772, WO 95/34671, WO 96/22378, WO 97/12986, WO 97/21826, and WO 03/02231 1.

D. Virus-Like Particles

In some embodiments, a virus-like particle (VLP) is provided that includes a disclosed immunogen (e.g., a recombinant HIV-1 Env ectodomain or immunogenic fragment thereof). VLPs lack the viral components that are required for virus replication and thus represent a highly attenuated, replication-incompetent form of a virus. However, the VLP can display a polypeptide (e.g., a recombinant HIV-1 Env protein) that is analogous to that expressed on infectious virus particles and should be equally capable of eliciting an immune response to HIV when administered to a subject. Virus like particles and methods of their production are known, and viral proteins from several viruses are known to form VLPs, including human papillomavirus, HIV (Kang et al., *Biol. Chem.* 380: 353-64 (1999)), Semliki-Forest virus (Notka et al., *Biol. Chem.* 380: 341-52 (1999)), human polyomavirus (Goldmann et al., *J. Virol.* 73: 4465-9 (1999)), rotavirus (Jiang et al., *Vaccine* 17: 1005-13 (1999)), parvovirus (Casal, *Biotechnology and Applied Biochemistry*, Vol 29, Part 2, pp 141-150 (1999)), canine parvovirus (Hurtado et al., *J. Virol.* 70: 5422-9 (1996)), hepatitis E virus (Li et al., *J. Virol.* 71: 7207-13 (1997)), and Newcastle disease virus. The formation of such VLPs can be detected by any suitable technique. Examples of suitable techniques known in the art for detection of VLPs in a medium include, e.g., electron microscopy techniques, dynamic light scattering (DLS), selective chromatographic separation (e.g., ion exchange, hydrophobic interaction, and/or size exclusion chromatographic separation of the VLPs) and density gradient centrifugation.

The virus like particle can include any of the recombinant gp120 proteins or recombinant HIV-1 Env ectodomain trimers or an immunogenic fragments thereof, that are disclosed herein.

E. Pharmaceutical Compositions

Immunogenic compositions comprising a disclosed immunogen (e.g., a recombinant gp120 protein or a HIV-1 Env ectodomain trimer comprising the recombinant gp120 protein) and a pharmaceutically acceptable carrier are also provided. Such pharmaceutical compositions can be administered to subjects by a variety of administration modes, for example, intramuscular, subcutaneous, intravenous, intra-arterial, intra-articular, intraperitoneal, or parenteral routes. In several embodiments, pharmaceutical compositions including one or more of the disclosed immunogens are immunogenic compositions. Actual methods for preparing administrable compositions will be known or apparent to those skilled in the art and are described in more detail in such publications as Remingtons Pharmaceutical Sciences, 19$^{th}$ Ed., Mack Publishing Company, Easton, Pa., 1995.

Thus, a immunogen described herein can be formulated with pharmaceutically acceptable carriers to help retain biological activity while also promoting increased stability during storage within an acceptable temperature range. Potential carriers include, but are not limited to, physiologically balanced culture medium, phosphate buffer saline solution, water, emulsions (e.g., oil/water or water/oil emulsions), various types of wetting agents, cryoprotective additives or stabilizers such as proteins, peptides or hydrolysates (e.g., albumin, gelatin), sugars (e.g., sucrose, lactose, sorbitol), amino acids (e.g., sodium glutamate), or other protective agents. The resulting aqueous solutions may be packaged for use as is or lyophilized Lyophilized preparations are combined with a sterile solution prior to administration for either single or multiple dosing.

Formulated compositions, especially liquid formulations, may contain a bacteriostat to prevent or minimize degradation during storage, including but not limited to effective concentrations (usually ≤1% w/v) of benzyl alcohol, phenol, m-cresol, chlorobutanol, methylparaben, and/or propylparaben. A bacteriostat may be contraindicated for some patients; therefore, a lyophilized formulation may be reconstituted in a solution either containing or not containing such a component.

The pharmaceutical compositions of the disclosure can contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, and triethanolamine oleate.

The pharmaceutical composition may optionally include an adjuvant to enhance an immune response of the host. Suitable adjuvants are, for example, toll-like receptor agonists, alum, AlPO4, alhydrogel, Lipid-A and derivatives or variants thereof, oil-emulsions, saponins, neutral liposomes, liposomes containing the vaccine and cytokines, non-ionic block copolymers, and chemokines. Non-ionic block polymers containing polyoxyethylene (POE) and polyxylpropylene (POP), such as POE-POP-POE block copolymers, MPL™ (3-O-deacylated monophosphoryl lipid A; Corixa, Hamilton, Ind.) and IL-12 (Genetics Institute, Cambridge, Mass.), among many other suitable adjuvants well known in the art, may be used as an adjuvant (Newman et al., 1998, *Critical Reviews in Therapeutic Drug Carrier Systems* 15:89-142). These adjuvants have the advantage in that they help to stimulate the immune system in a non-specific way, thus enhancing the immune response to a pharmaceutical product.

In some instances it may be desirable to combine a disclosed immunogen, with other pharmaceutical products (e.g., vaccines) which induce protective responses to other agents. For example, a composition including a recombinant paramyxovirus as described herein can be can be administered simultaneously (typically separately) or sequentially with other vaccines recommended by the Advisory Committee on Immunization Practices (ACIP; cdc.gov/vaccines/acip/index.html) for the targeted age group (e.g., infants from approximately one to six months of age). As such, a dicalosed immunogen including a recombinant HIV-1 gp120 protein described herein may be administered simultaneously or sequentially with vaccines against, for example, hepatitis B (HepB), diphtheria, tetanus and pertussis (DTaP), pneumococcal bacteria (PCV), *Haemophilus influenzae* type b (Hib), polio, influenza and rotavirus.

In some embodiments, the composition can be provided as a sterile composition. The pharmaceutical composition typically contains an effective amount of a disclosed immunogen and can be prepared by conventional techniques. Typically, the amount of immunogen in each dose of the immunogenic composition is selected as an amount which induces an immune response without significant, adverse side effects. In some embodiments, the composition can be provided in unit dosage form for use to induce an immune response in a subject, for example, to induce an immune response that inhibits or prevents HIV-1 infection in the subject. A unit dosage form contains a suitable single preselected dosage for administration to a subject, or suitable marked or measured multiples of two or more preselected unit dosages, and/or a metering mechanism for administering the unit dose or multiples thereof. In other embodiments, the composition further includes an adjuvant.

III. Therapeutic Methods

The disclosed immunogens (e.g., a recombinant gp120 protein or a HIV-1 Env ectodomain trimer comprising the recombinant gp120 protein), polynucleotides and vectors encoding the disclosed immunogens, and compositions including same, can be used in methods of inducing an immune response to HIV-1 to prevent, inhibit, and/or treat an HIV-1 infection.

When inhibiting, treating, or preventing HIV-1 infection, the methods can be used either to avoid infection in an HIV-1 seronegative subject (e.g., by inducing an immune response that protects against HIV-1 infection), or to treat existing infection in an HIV-1 seropositive subject. The HIV-1 seropositive subject may or may not carry a diagnosis of AIDS. Hence in some embodiments the methods involves selecting a subject at risk for contracting HIV-1 infection, or a subject at risk of developing AIDS (such as a subject with HIV-1 infection), and administering a disclosed immunogen to the subject to elicit an immune response to HIV-1 in the subject.

Treatment of HIV-1 by inhibiting HIV-1 replication or infection can include delaying the development of AIDS in a subject. Treatment of HIV-1 can also include reducing signs or symptoms associated with the presence of HIV-1 (for example, by reducing or inhibiting HIV-1 replication).

In some examples, treatment using the methods disclosed herein prolongs the time of survival of the subject.

Typical subjects intended for treatment with the therapeutics and methods of the present disclosure include humans, as well as non-human primates and other animals. To identify subjects for prophylaxis or treatment according to the methods of the disclosure, accepted screening methods are employed to determine risk factors associated with a targeted or suspected disease or condition, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods, which are available and well known in the art to detect and/or characterize HIV-1 infection. These and other routine methods allow the clinician to select patients in need of therapy using the methods and pharmaceutical compositions of the disclosure. In accordance with these methods and principles, a composition can be administered according to the teachings herein, or other conventional methods, as an independent prophylaxis or treatment program, or as a follow-up, adjunct or coordinate treatment regimen to other treatments.

The administration of a disclosed immunogen can be for prophylactic or therapeutic purpose. When provided prophylactically, the disclosed therapeutic agents are provided in advance of any symptom, for example, in advance of infection. The prophylactic administration of the disclosed therapeutic agents serves to prevent or ameliorate any subsequent infection. When provided therapeutically, the disclosed therapeutic agents are provided at or after the onset of a symptom of disease or infection, for example, after development of a symptom of HIV-1 infection, or after diagnosis of HIV-1 infection. The therapeutic agents can thus be provided prior to the anticipated exposure to HIV-1 virus so as to attenuate the anticipated severity, duration or extent of an infection and/or associated disease symptoms, after exposure or suspected exposure to the virus, or after the actual initiation of an infection.

The immunogenic composition including one or more of the disclosed immunogens, can be used in coordinate (or prime-boost) vaccination protocols or combinatorial formulations. In certain embodiments, novel combinatorial immunogenic compositions and coordinate immunization protocols employ separate immunogens or formulations, each directed toward eliciting an anti-HIV-1 immune response, such as an immune response to HIV-1 Env protein. Separate immunogenic compositions that elicit the anti-HIV-1 immune response can be combined in a polyvalent immunogenic composition administered to a subject in a single immunization step, or they can be administered separately (in monovalent immunogenic compositions) in a coordinate immunization protocol.

In one embodiment, a suitable immunization regimen includes at least two separate inoculations with one or more immunogenic compositions including a disclosed immunogen, with a second inoculation being administered more than about two, about three to eight, or about four, weeks following the first inoculation. A third inoculation can be administered several months after the second inoculation, and in specific embodiments, more than about five months after the first inoculation, more than about six months to about two years after the first inoculation, or about eight months to about one year after the first inoculation. Periodic inoculations beyond the third are also desirable to enhance the subject's "immune memory." The adequacy of the vaccination parameters chosen, e.g., formulation, dose, regimen and the like, can be determined by taking aliquots of serum from the subject and assaying antibody titers during the course of the immunization program. Alternatively, the T cell populations can be monitored by conventional methods. In addition, the clinical condition of the subject can be monitored for the desired effect, e.g., prevention of HIV-1 infection or progression to AIDS, improvement in disease state (e.g., reduction in viral load), or reduction in transmission frequency to an uninfected partner. If such monitoring indicates that vaccination is sub-optimal, the subject can be boosted with an additional dose of immunogenic composition, and the vaccination parameters can be modified in a fashion expected to potentiate the immune response. Thus, for example, the dose of the disclosed recombinant HIV-1 Env protein, immunogenic fragment thereof, protein nanoparticle, polynucleotide encoding a recombinant HIV-1 Env ectodomain or immunogenic fragment, vector or composition and/or adjuvant can be increased or the route of administration can be changed.

It is contemplated that there can be several boosts, and that each boost can be a different disclosed immunogen. It is also contemplated in some examples that the boost may be the same immunogen as another boost, or the prime.

The prime and the boost can be administered as a single dose or multiple doses, for example, two doses, three doses, four doses, five doses, six doses or more can be administered to a subject over days, weeks or months. Multiple boosts can also be given, such one to five, or more. Different dosages can be used in a series of sequential inoculations. For example, a relatively large dose in a primary inoculation and then a boost with relatively smaller doses. The immune response against the selected antigenic surface can be generated by one or more inoculations of a subject.

Upon administration of a disclosed immunogen of this disclosure, the immune system of the subject typically responds to the immunogenic composition by producing antibodies specific for HIV-1 Env protein. Such a response signifies that an immunologically effective dose was delivered to the subject.

An immunologically effective dosage can be achieved by single or multiple administrations (including, for example, multiple administrations per day), daily, or weekly administrations. For each particular subject, specific dosage regimens can be evaluated and adjusted over time according to the individual need and professional judgment of the person administering or supervising the administration of the immunogenic composition. In some embodiments, the antibody response of a subject will be determined in the context of evaluating effective dosages/immunization protocols. In most instances it will be sufficient to assess the antibody titer in serum or plasma obtained from the subject. Decisions as to whether to administer booster inoculations and/or to change the amount of the therapeutic agent administered to the individual can be at least partially based on the antibody titer level. The antibody titer level can be based on, for example, an immunobinding assay which measures the concentration of antibodies in the serum which bind to an antigen including, for example, a disclosed recombinant HIV-1 Env protein. The methods of using immunogenic composition, and the related compositions and methods of the disclosure are useful in increasing resistance to, inhibiting, preventing, ameliorating, and/or treating infection and disease caused by HIV-1 in animal hosts, and other, in vitro applications.

In several embodiments, a disclosed immunogen can be administered to the subject simultaneously with the administration of an adjuvant. In other embodiments, the immunogen can be administered to the subject after the administration of an adjuvant and within a sufficient amount of time to induce the immune response.

Determination of effective dosages in this context is typically based on animal model studies followed up by human clinical trials and is guided by administration protocols that significantly reduce the occurrence or severity of targeted disease symptoms or conditions in the subject, or that induce a desired response in the subject (such as a neutralizing immune response). Suitable models in this regard include, for example, murine, rat, porcine, feline, ferret, non-human primate, and other accepted animal model subjects known in the art. Alternatively, effective dosages can be determined using in vitro models (for example, immunologic and histopathologic assays). Using such models, only ordinary calculations and adjustments are required to determine an appropriate concentration and dose to administer a therapeutically effective amount of the composition (for example, amounts that are effective to elicit a desired immune response or alleviate one or more symptoms of a targeted disease). In alternative embodiments, an effective amount or effective dose of the composition may simply inhibit or enhance one or more selected biological activities correlated with a disease or condition, as set forth herein, for either therapeutic or diagnostic purposes.

Dosage can be varied by the attending clinician to maintain a desired concentration at a target site (for example, systemic circulation). Higher or lower concentrations can be selected based on the mode of delivery, for example, transepidermal, rectal, oral, pulmonary, or intranasally delivery versus intravenous or subcutaneous delivery. The actual dosage of disclosed immunogen will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the composition for eliciting the desired activity or biological response in the subject. Dosage regimens can be adjusted to provide an optimum prophylactic or therapeutic response. As described above in the forgoing listing of terms, a therapeutically effective amount is also one in which any toxic or detrimental side effects of the disclosed immunogen and/or other biologically active agent is outweighed in clinical terms by therapeutically beneficial effects.

A non-limiting range for a therapeutically effective amount of the disclosed immunogen within the methods and immunogenic compositions of the disclosure is about 0.0001 mg/kg body weight to about 10 mg/kg body weight, such as about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.5 mg/kg, about 2 mg/kg, about 2.5 mg/kg, about 3 mg/kg, about 4 mg/kg, about 5 mg/kg, or about 10 mg/kg, for example, 0.01 mg/kg to about 1 mg/kg body weight, about 0.05 mg/kg to about 5 mg/kg body weight, about 0.2 mg/kg to about 2 mg/kg body weight, or about 1.0 mg/kg to about 10 mg/kg body weight. In some embodiments, the dosage includes a set amount of a disclosed immunogen such as from about 1-300 µg, for example, a dosage of about 1, 2, 3, 4, 5, 6, 7, 8, 9, 10, 15, 20, 30, 40, 50, 60, 70, 80, 90, 100, 150, 200, 250, or about 300 µg.

The dosage and number of doses will depend on the setting, for example, in an adult or anyone primed by prior HIV-1 infection or immunization, a single dose may be a sufficient booster. In naive subjects, in some examples, at least two doses would be given, for example, at least three doses. In some embodiments, an annual boost is given, for example, along with an annual influenza vaccination.

Actual methods for preparing administrable compositions will be known or apparent to those skilled in the art and are described in more detail in such publications as *Remington Pharmaceutical Sciences*, 19$^{th}$ Ed., Mack Publishing Company, Easton, Pa., 1995.

In several embodiments, it may be advantageous to administer the therapeutic agents disclosed herein with other agents such as proteins, peptides, antibodies, and other antiviral agents, such as anti-HIV-1 agents. Examples of such anti-HIV-1 therapeutic agents include nucleoside reverse transcriptase inhibitors, such as abacavir, AZT, didanosine, emtricitabine, lamivudine, stavudine, tenofovir, zalcitabine, zidovudine, and the like, non-nucleoside reverse transcriptase inhibitors, such as delavirdine, efavirenz, nevirapine, protease inhibitors such as amprenavir, atazanavir, indinavir, lopinavir, nelfinavir, osamprenavir, ritonavir, saquinavir, tipranavir, and the like, and fusion protein inhibitors such as enfuvirtide and the like. In some examples, the disclosed therapeutic agents are administered with T-helper cells, such as exogenous T-helper cells. Exemplary methods for producing and administering T-helper cells can be found in International Patent Publication WO 03/020904, which is incorporated herein by reference.

For any application, treatment with a disclosed immunogen can be combined with anti-retroviral therapy, such as HAART. Antiretroviral drugs are broadly classified by the phase of the retrovirus life-cycle that the drug inhibits. The therapeutic agents can be administered before, during, concurrent to and/or after retroviral therapy. In some embodiments, the therapeutic agents are administered following a course of retroviral therapy. The disclosed therapeutic agents can be administered in conjunction with nucleoside and nucleotide reverse transcriptase inhibitors (nRTI), non-nucleoside reverse transcriptase inhibitors (NNRTI), protease inhibitors, Entry inhibitors (or fusion inhibitors), Maturation inhibitors, or a broad spectrum inhibitors, such as natural antivirals. Exemplary agents include lopinavir, ritonavir, zidovudine, lamivudine, tenofovir, emtricitabine and efavirenz.

In some embodiments, the disclosed immunogen is administered to the subject simultaneously with the administration of the adjuvant. In other embodiments, the disclosed immunogen is administered to the subject after the administration of the adjuvant and within a sufficient amount of time to induce the immune response.

HIV-1 infection does not need to be completely eliminated or reduced or prevented for the methods to be effective. For example, elicitation of an immune response to HIV-1 with one or more of the disclosed immunogens can reduce or inhibit HIV-1 infection by a desired amount, for example, by at least 10%, at least 20%, at least 50%, at least 60%, at least 70%, at least 80%, at least 90%, at least 95%, at least 98%, or even at least 100% (elimination or prevention of detectable HIV-1 infected cells), as compared to HIV-1 infection in the absence of the therapeutic agent. In additional examples, HIV-1 replication can be reduced or inhibited by the disclosed methods. HIV-1 replication does not need to be completely eliminated for the method to be effective. For example, the immune response elicited using one or more of the disclosed immunogens can reduce HIV-1 replication by a desired amount, for example, by at least 10%, at least 20%, at least 50%, at least 60%, at least 70%, at least 80%, at least 90%, at least 95%, at least 98%, or even at least 100% (elimination or prevention of detectable HIV-1 replication), as compared to HIV-1 replication in the absence of the immune response.

To successfully reproduce itself, HIV-1 must convert its RNA genome to DNA, which is then imported into the host cell's nucleus and inserted into the host genome through the action of HIV-1 integrase. Because HIV-1's primary cellular target, CD4+ T-Cells, can function as the memory cells of the immune system, integrated HIV-1 can remain dormant for the duration of these cells' lifetime. Memory T-Cells may survive for many years and possibly for decades. This latent HIV-1 reservoir can be measured by co-culturing CD4+ T-Cells from infected patients with CD4+ T-Cells from uninfected donors and measuring HIV-1 protein or RNA (See, e.g., Archin et al., *AIDS*, 22:1131-1135, 2008). In some embodiments, the provided methods of treating or inhibiting HIV-1 infection include reduction or elimination of the latent reservoir of HIV-1 infected cells in a subject. For example, a reduction of at least 10%, at least 20%, at least 50%, at least 60%, at least 70%, at least 80%, at least 90%, at least 95%, at least 98%, or even at least 100% (elimination of detectable HIV-1) of the latent reservoir of HIV-1 infected cells in a subject, as compared to the latent reservoir of HIV-1 infected cells in a subject in the absence of the treatment with one or more of the provided immunogens.

Studies have shown that the rate of HIV-1 transmission from mother to infant is reduced significantly when zidovudine is administered to HIV-1-infected women during pregnancy and delivery and to the offspring after birth (Connor et al., 1994 *Pediatr Infect Dis J* 14: 536-541). Several studies of mother-to-infant transmission of HIV-1 have demonstrated a correlation between the maternal virus load at delivery and risk of HIV-1 transmission to the child. The disclosed immunogens are of use in decreasing HIV-1-transmission from mother to infant. Thus, in some embodiments a therapeutically effective amount of one or more of the provided therapeutic agents is administered in order to prevent transmission of HIV-1, or decrease the risk of transmission of HIV-1, from a mother to an infant. In some embodiments, a therapeutically effective amount of the agent can be administered to a pregnant subject to induce an immune response that generates neutralizing antibodies that are passes to the fetus via the umbilical cord to protect the fetus from infection during birth. In some embodiments, both a therapeutically effective amount of a disclosed immunogen and a therapeutically effective amount of another anti-HIV-1 agent, such as zidovudine, is administered to the mother and/or infant. Following immunization of a subject, serum can be collected from the subject at appropriate time points, frozen, and stored for neutralization testing. Methods to assay for neutralization activity are known and are further described herein, and include, but are not limited to, plaque reduction neutralization (PRNT) assays, microneutralization assays, flow cytometry based assays, single-cycle infection assays (e.g., as described in Martin et al. (2003) *Nature Biotechnology* 21:71-76), and pseudovirus neutralization assays (e.g., as described in Georgiev et al. (Science, 340, 751-756, 2013), Seaman et al. (J. Virol., 84, 1439-1452, 2005), and Mascola et al. (J. Virol., 79, 10103-10107, 2005), each of which is incorporated by reference herein in its entirety. In some embodiments, the serum neutralization activity can be assayed using a panel of HIV-1 pseudoviruses as described in Georgiev et al., Science, 340, 751-756, 2013 or Seaman et al. J. Virol., 84, 1439-1452, 2005. Briefly, pseudovirus stocks are prepared by co-transfection of 293T cells with an HIV-1 Env-deficient backbone and an expression plasmid encoding the Env gene of interest. The serum to be assayed is diluted in Dulbecco's modified Eagle medium-10% FCS (Gibco) and mixed with pseudovirus. After 30 min, 10,000 TZM-bl cells are added, and the plates are incubated for 48 hours. Assays are developed with a luciferase assay system (Promega, Madison, Wis.), and the relative light units (RLU) are read on a luminometer (Perkin-Elmer, Waltham, Mass.). To account for background, a cutoff of $ID_{50} \geq 40$ can be used as a criterion for the presence of serum neutralization activity against a given pseudovirus.

In some embodiments, administration of a therapeutically effective amount of one or more of the disclosed immunogen to a subject (e.g., by a prime-boost administration of a DNA vector encoding a disclosed immunogen (prime) followed by a protein nanoparticle including a disclosed immunogen (boost)) induces a neutralizing immune response in the subject, wherein serum from the subject neutralizes, with an $ID_{50} \geq 40$, at least 30% (such as at least 40%, at least 50%, at least 60%, at least 70%, at least 80%, or at least 90%) of pseudoviruses is a panel of pseudoviruses including the HIV-1 Env proteins listed in Table S5 or Table S6 of Georgiev et al. (Science, 340, 751-756, 2013), or Table 1 of Seaman et al. (J. Virol., 84, 1439-1452, 2005).

One approach to administration of nucleic acids is direct immunization with plasmid DNA, such as with a mammalian expression plasmid. Immunization by nucleic acid constructs is well known in the art and taught, for example, in U.S. Pat. No. 5,643,578 (which describes methods of immunizing vertebrates by introducing DNA encoding a desired antigen to elicit a cell-mediated or a humoral response), and U.S. Pat. No. 5,593,972 and U.S. Pat. No. 5,817,637 (which describe operably linking a nucleic acid sequence encoding an antigen to regulatory sequences enabling expression). U.S. Pat. No. 5,880,103 describes several methods of delivery of nucleic acids encoding immunogenic peptides or other antigens to an organism. The methods include liposomal delivery of the nucleic acids (or of the synthetic peptides themselves), and immune-stimulating constructs, or ISCOMS™, negatively charged cage-like structures of 30-40 nm in size formed spontaneously on mixing cholesterol and Quil A™ (saponin). Protective immunity has been generated in a variety of experimental models of infection, including toxoplasmosis and Epstein-Barr virus-induced tumors, using ISCOMS™ as the delivery vehicle for antigens (Mowat and Donachie, *Immunol. Today* 12:383, 1991). Doses of antigen as low as 1 µg encapsulated in ISCOMS™ have been found to produce Class I mediated CTL responses (Takahashi et al., *Nature* 344:873, 1990).

In some embodiments, a plasmid DNA vaccine is used to express a disclosed immunogen in a subject. For example, a nucleic acid molecule encoding a disclosed immunogen can be administered to a subject to induce an immune response to HIV-1 gp120. In some embodiments, the nucleic acid molecule can be included on a plasmid vector for DNA immunization, such as the pVRC8400 vector (described in Barouch et al., J. Virol, 79, 8828-8834, 2005, which is incorporated by reference herein).

In another approach to using nucleic acids for immunization, a disclosed recombinant gp120 protein or HIV-1 Env ectodomain trimer can be expressed by attenuated viral hosts or vectors or bacterial vectors. Recombinant vaccinia virus, adeno-associated virus (AAV), herpes virus, retrovirus, cytogmeglo virus or other viral vectors can be used to express the peptide or protein, thereby eliciting a CTL response. For example, vaccinia vectors and methods useful in immunization protocols are described in U.S. Pat. No. 4,722,848. BCG (Bacillus Calmette Guerin) provides another vector for expression of the peptides (see Stover, *Nature* 351:456-460, 1991).

In one embodiment, a nucleic acid encoding a disclosed recombinant gp120 protein or HIV-1 Env ectodomain trimer is introduced directly into cells. For example, the nucleic acid can be loaded onto gold microspheres by standard methods and introduced into the skin by a device such as Bio-Rad's HELIOS™ Gene Gun. The nucleic acids can be "naked," consisting of plasmids under control of a strong promoter. Typically, the DNA is injected into muscle, although it can also be injected directly into other sites. Dosages for injection are usually around 0.5 µg/kg to about 50 mg/kg, and typically are about 0.005 mg/kg to about 5 mg/kg (see, e.g., U.S. Pat. No. 5,589,466).

Additional Information Pertaining to a Neutralizing Immune Response

The disclosed recombinant gp120 proteins and/or HIV-1 Env ectodomain trimers can be used to induce a neutralizing immune response to HIV-1 in a subject. In several such embodiments, induction of the immune response includes production of neutralizing antibodies to HIV-1, such as broadly neutralizing antibodies.

In several embodiments, following immunization of a subject with a disclosed immunogen, serum can be collected from the subject at appropriate time points, frozen, and stored for neutralization testing. Methods to assay for neutralization activity are known and are further described herein, and include, but are not limited to, plaque reduction neutralization (PRNT) assays, microneutralization assays, flow cytometry based assays, single-cycle infection assays (e.g., as described in Martin et al. (2003) *Nature Biotechnology* 21:71-76), and pseudovirus neutralization assays (e.g., as described in Georgiev et al. (Science, 340, 751-756, 2013), Seaman et al. (J. Virol., 84, 1439-1452, 2005), and Mascola et al. (J. Virol., 79, 10103-10107, 2005), each of which is incorporated by reference herein in its entirety.

In some embodiments, the serum neutralization activity can be assayed using a panel of HIV-1 pseudoviruses as described in Georgiev et al., Science, 340, 751-756, 2013 or Seaman et al. J. Virol., 84, 1439-1452, 2005. Briefly, pseudovirus stocks are prepared by co-transfection of 293T cells with an HIV-1 Env-deficient backbone and an expression plasmid encoding the Env gene of interest. The serum to be assayed is diluted in Dulbecco's modified Eagle medium-10% FCS (Gibco) and mixed with pseudovirus. After 30 min, 10,000 TZM-bl cells are added, and the plates are incubated for 48 hours. Assays are developed with a luciferase assay system (Promega, Madison, Wis.), and the relative light units (RLU) are read on a luminometer (Perkin-Elmer, Waltham, Mass.). To account for background, a cutoff of $ID_{50} \geq 40$ can be used as a criterion for the presence of serum neutralization activity against a given pseudovirus.

In some embodiments, administration of a therapeutically effective amount of one or more of the disclosed immunogens to a subject (e.g., by a prime-boost administration of a DNA vector encoding a disclosed recombinant gp120 protein, such as a gp140 protein, gp145 protein, or gp160 protein including a disclosed recombinant gp120 protein (prime) followed by a protein subunit or protein nanoparticle including a disclosed HIV-1 Env ectodomain trimer (boost)) induces a neutralizing immune response in the subject. In several embodiments, the neutralizing immune response can be detected using a pseudovirus neutralization assay against a panel of HIV-1 pseudoviruses including HIV-1 Env proteins from different HIV-1 strains. In one example, the panel can include pseudoviruses including Env proteins from Clade A, Clade B, and Clade C Tier-2 HIV-1 strains. In other examples, the panel can include pseudoviruses including Env proteins from the HIV-1 strains listed in Table S5 or Table S6 of Georgiev et al. (Science, 340, 751-756, 2013, which is incorporated by reference herein in its entirety), or Table 1 of Seaman et al. (J. Virol., 84, 1439-1452, 2005, which is incorporated by reference herein in its entirety).

In some embodiments, administration of a therapeutically effective amount of one or more of the disclosed immunogen to a subject (e.g., by a prime-boost administration of a DNA vector encoding a disclosed recombinant gp120 protein, such as a gp140 protein, gp145 protein, or gp160 protein including a disclosed recombinant gp120 protein (prime) followed by a protein subunit or protein nanoparticle including a disclosed HIV-1 Env ectodomain trimer (boost)) induces a neutralizing immune response in the subject, wherein serum from the subject neutralizes, with an $ID_{50} \geq 40$, at least 30% (such as at least 40%, at least 50%, at least 60%, at least 70%, at least 80%, or at least 90%) of pseudoviruses in a panel of pseudoviruses including Env proteins from Clade A, Clade B, and Clade C Tier-2 HIV-1 strains, such as the HIV-1 Env proteins listed in Table S5 or Table S6 of Georgiev et al. (Science, 340, 751-756, 2013), or Table 1 of Seaman et al. (J. Virol., 84, 1439-1452, 2005).

EXAMPLES

The following examples are provided to illustrate particular features of certain embodiments, but the scope of the claims should not be limited to those features exemplified.

Example 1

Interdomain Locking Stabilize the HIV-1 Envelope Structure for Induction of Broad and Potent Neutralizing Antibodies A major obstacle to the development of a protective HIV-1 vaccine is the intrinsic flexibility of the viral envelope trimer, which conceals conserved neutralization epitopes via conformational masking (Wyatt and Sodroski, *Science* 280, 1884-1888, 1998; Kwong, *Nature,* 420, 678-682, 2002; Chen, *Science,* 326, 1123-1127, 2009). This remarkable plasticity of the viral envelope spike underlies the belated and inconsistent appearance of broadly neutralizing antibodies in HIV-infected individuals (Mascola and Haynes, *Immunol. Rev.,* 254, 225-244, 2013; Burton and Mascola, *Nat. Immunol.,* 16, 571-576, 2015; West et al., *Cell,* 156, 633-648, 2014), as well as the failure of experimental vaccines to elicit such antibodies (Gilbert et al., *J. Infect. Dis.,* 202, 595-605, 2010; Haynes et al., *New Engl. J. Med.,* 366, 1275-1286, 2012; Rolland et al., *Nature,* 490, 417-420, 2012; Kim et al., *Annu. Rev. Med.,* 66, 6.1-6.15, 2014). This example provides novel approaches for stabilizing the HIV-1 envelope trimer in its native pre-fusion conformation via gp120 inter-domain locks applied to a region of molecular mimicry with the CD4 receptor. Introduction of neo-disulfide bridges between the inner domain al-helix and the outer domain C4 region effectively stabilize the structure of both soluble cleaved gp140 trimers and full-length envelopes from diverse HIV-1 isolates. The stabilized HIV-1 envelopes display reduced conformational flexibility and restricted antigenic profile with increased recognition by potently neutralizing antibodies and lack of reactivity with non-neutralizing antibodies. Furthermore, the inter-domain locks abrogate the ability to bind CD4. Rabbits immunized with locked envelope mutants using a DNA-prime/protein-boost protocol developed antibodies with cross-Glade tier-2 neutralizing capacity, indicating that structural stabilization may be critical to the induction of broad and potent HIV-1 neutralizing antibodies. These results identify interdomain-stabilized envelopes as potential components of a protective HIV-1 vaccine.

The presence of an identical stretch of 5 amino acids (SLWDQ) in both HIV-1 gp120 (residues 110-114 in the C-terminal region of the al-helix) and human CD4 (residues 60-64 in the DE loop of domain 1) (FIG. 5A) was first reported in 1992 and initially suggested as a potential inductive mechanism for autoimmunity (Zagury et al., Lancet, 340, 8817, 1992; Zagury et al., P.N.A.S., 90, 7573-7577, 1993). The two domains share a high degree of structural homology, both adopting a helical conformation with all-atom RMSD values of 1.04-1.13 for gp120 derived from different HIV-1 isolates (FIG. 5B). Accordingly, this remarkable structural homology might translate into functional mimicry. Since in the crystal structure of a native-like soluble gp140 trimer (BG505-SOSIP.664) D113 in the gp120 SLWDQ region forms a salt bridge with R429 in the β20-β21 loop (Julien et al., Science, 342, 1477-1483, 2013; Pancera et al., Nature, 514, 455-461, 2014; Kwon et al., Nat. Struct. Mol. Biol., 22, 522-531, 2015; Garces et al., Immunity, 43, 1053-1063, 2015) (FIG. 5C), we considered the possibility that, upon binding to CD4, R429 could switch outwards to form a salt bridge with D63 in the mimetic SLWDQ region of CD4 (FIG. 5D). Although R429 is almost exclusively present in Glade-A HIV-1 isolates, the vast majority of non-Glade-A isolates display a positively-charged residue (lysine or arginine) at position 432 (FIG. 6A), which is also favorably positioned to form a salt bridge with both gp120 D113 and CD4 D63 (FIG. 6B).

Figure 7:
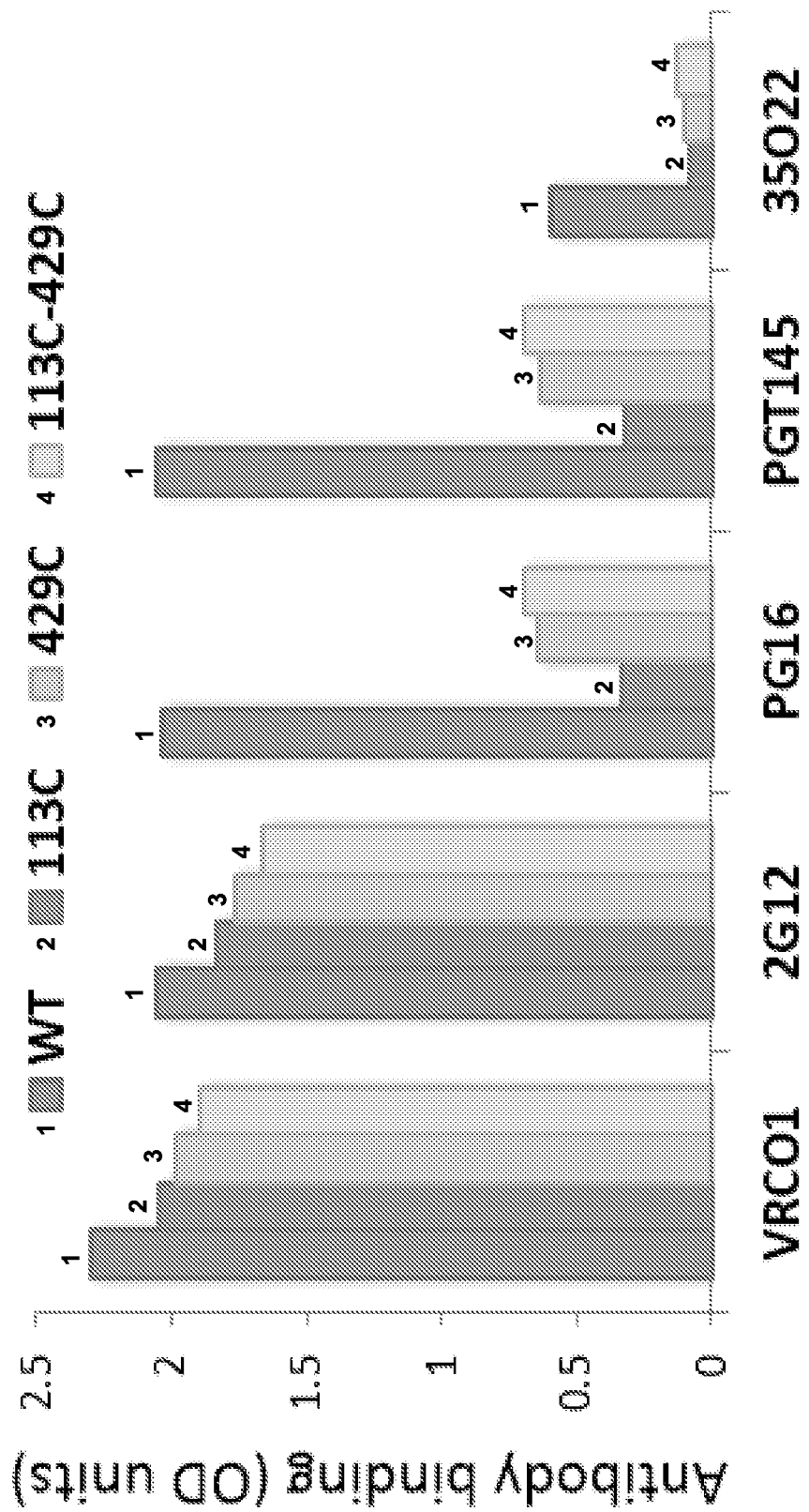
Figure 8A:
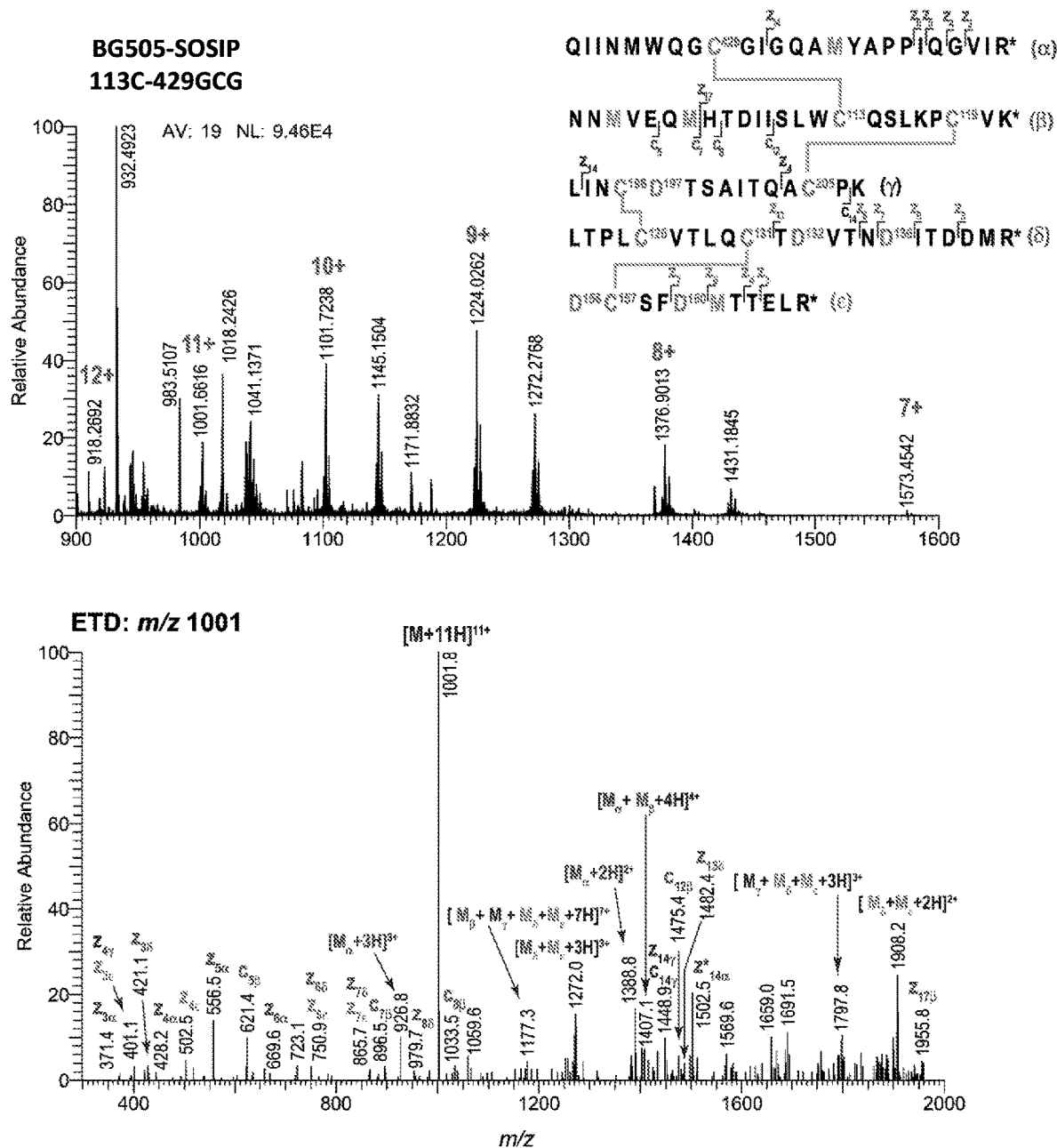
Figure 8B:
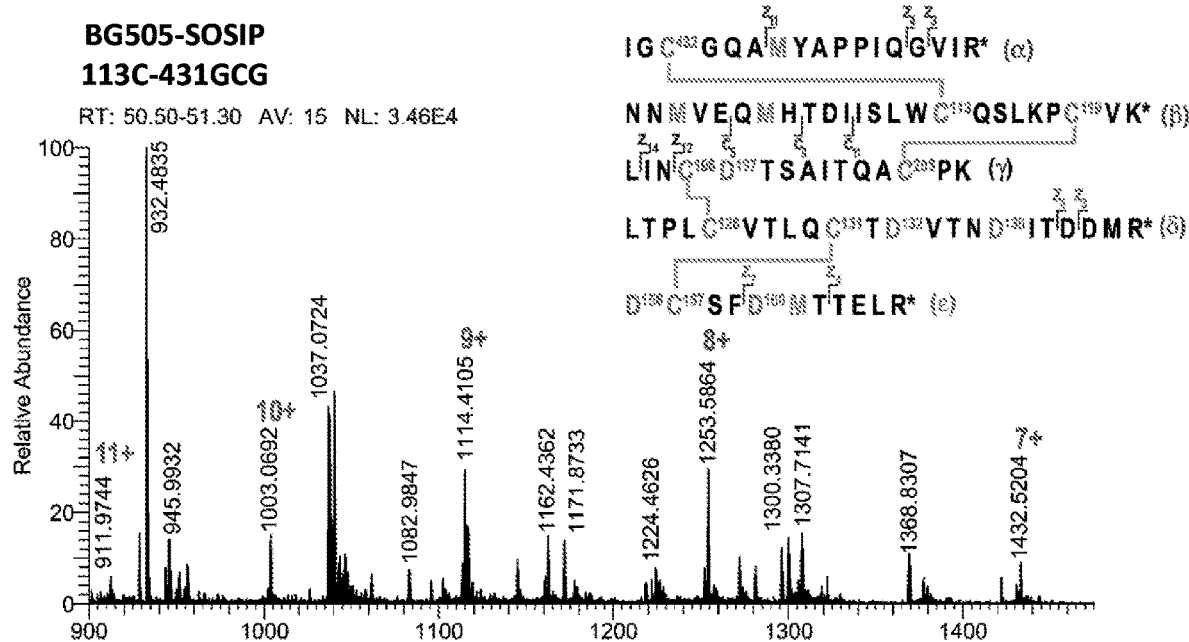
Figure 8B:
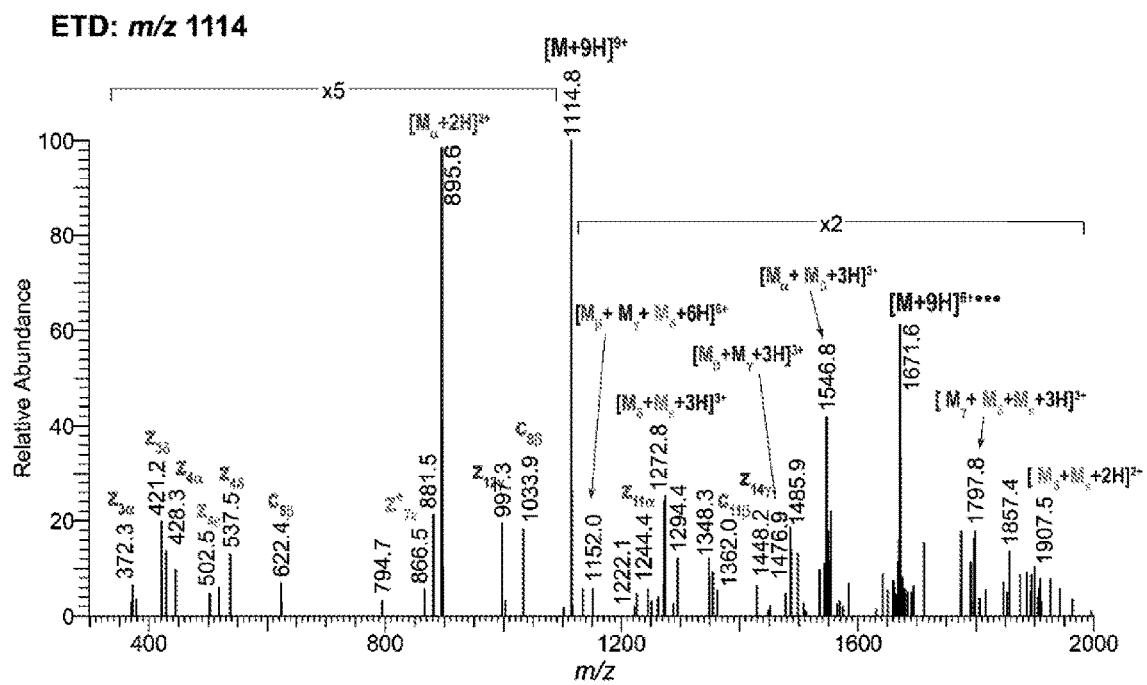
Figure 8C:
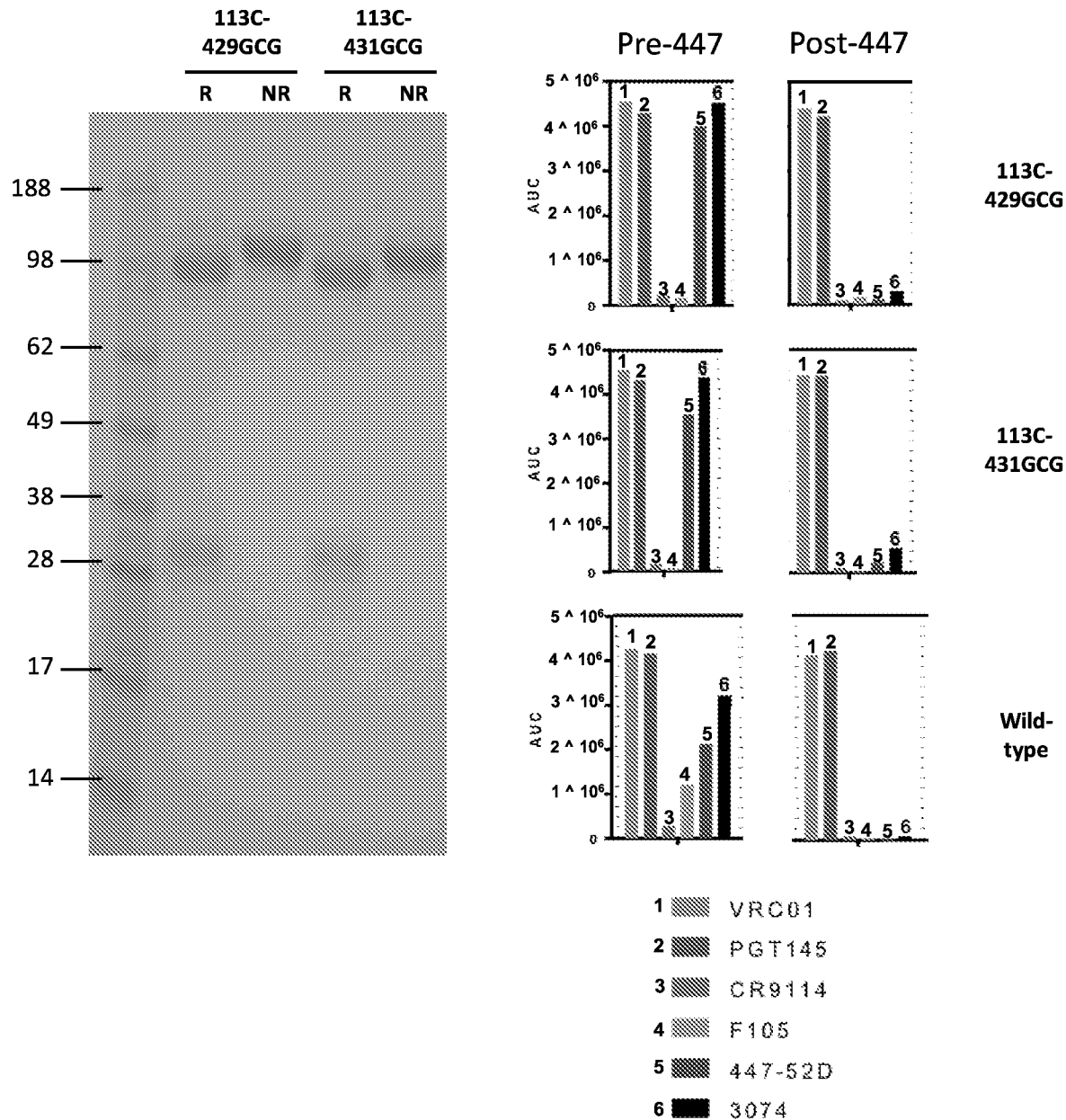
Figure 8C:
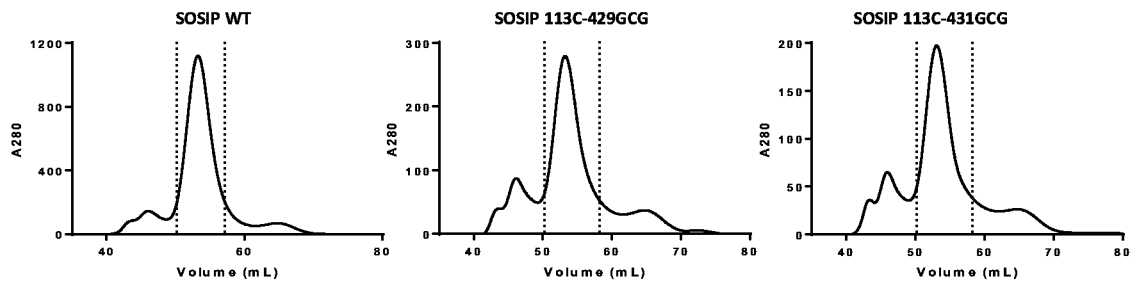
Figure 10A:
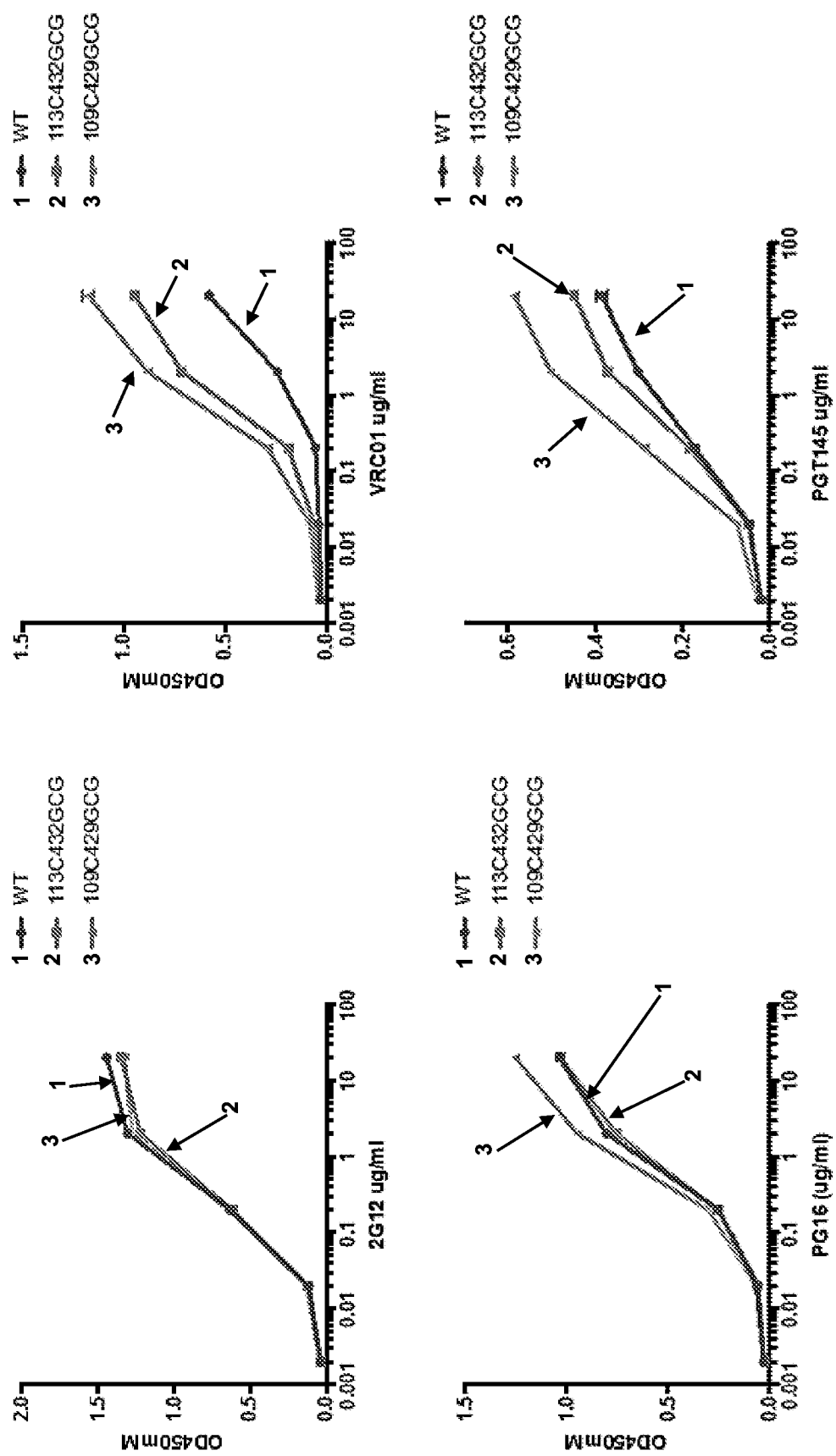
Figure 10B:
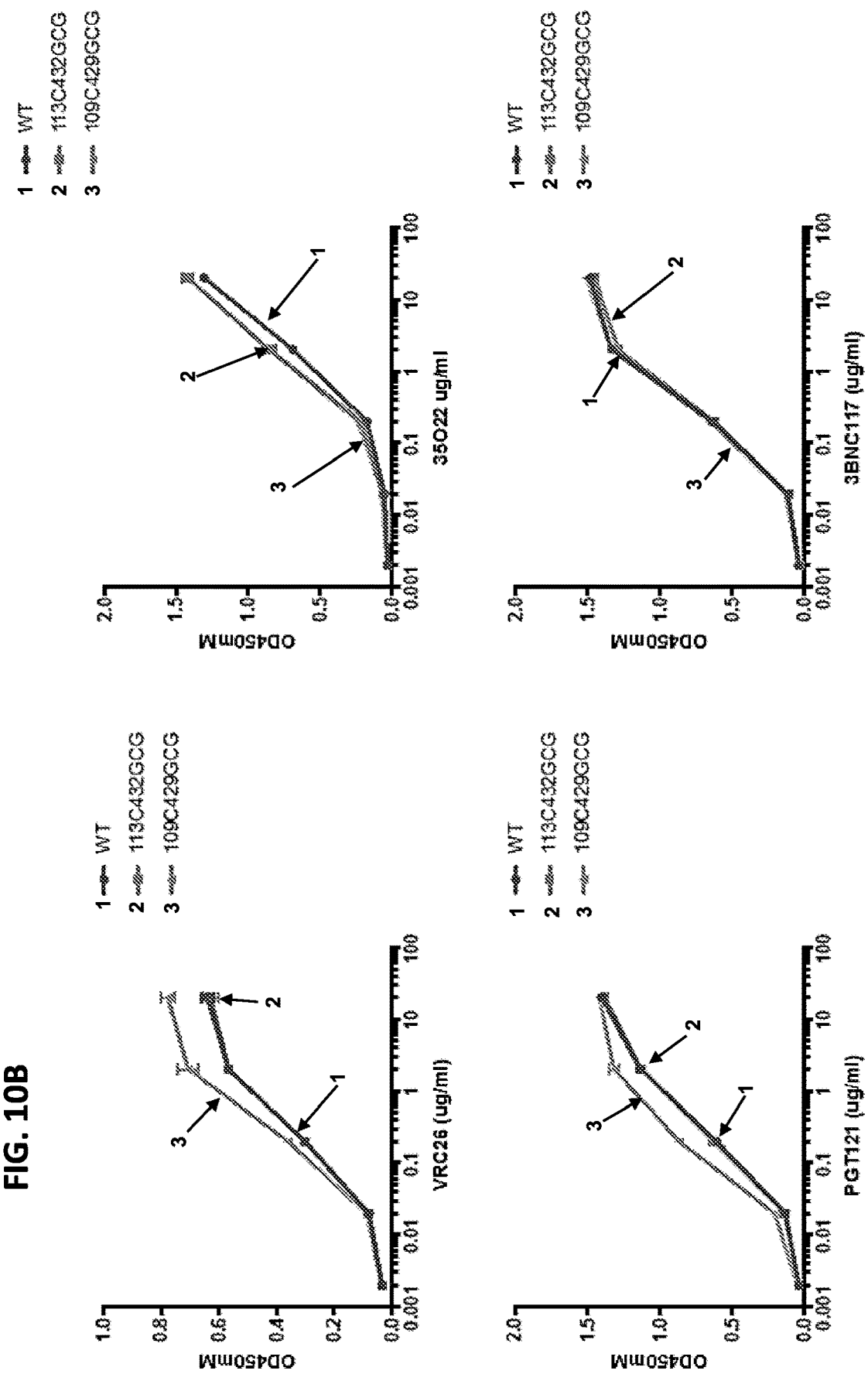

Introduction of interdomain neo-disulfide bridges into soluble trimers. Since the intramolecular interaction between the gp120 SLWDQ region and the β20-β21 loop appears to contribute to stabilizing the closed pre-fusion conformation of the HIV-1 envelope trimer by tightening the association between the inner and outer gp120 domains, it was reasoned that introduction of a covalent bond should cement the inter-domain interaction, reducing the inherent conformational flexibility of the trimer that constitutes a key obstacle to the development of an effective vaccine. Accordingly, D113 and R429 were mutated to cysteine, either individually or in combination, in a soluble cleaved gp140 trimer (e.g., BG505-SOSIP.664) (the BG505-SOSIP.664 trimer has been previously described, Julien et al., Science, 342, 1477-1483, 2013; Pancera et al., Nature, 514, 455-461, 2014; Kwon et al., Nat. Struct. Mol. Biol., 22, 522-531, 2015; Garces et al., Immunity, 43, 1053-1063, 2015; Sanders et al., PLoS Pathog., 9, e1003618, 2013), and the mutants were tested for their reactivity with a panel of anti-envelope monoclonal antibodies (mAbs). The two single mutants ($SOSIP_{113C}$ and $SOSIP_{429C}$), used as controls, displayed reduced reactivity with trimer-preferring mAbs in ELISA, suggesting that disruption of the 113-429 interaction weakens the inter-domain association; however, no rescue of the reactivity with these mAbs was observed with the double mutant, $SOSIP_{113C-429C}$, suggesting that the neo-disulfide bond had not formed (FIG. 7). One possibility is that this failure could be due to the excessive distance between C113 and C429, which would be incompatible with the formation of a disulfide bond. Thus, spacer glycine residues were inserted on both sides of C429 to produce a new double mutant ($SOSIP_{113C-429GCG}$), which was extensively purified by 3-step chromatography, including removal of the misfolded fraction reactive with MAb 447-52D. Analysis of the new mutant by mass-spectrometry (MS) documented the efficient formation of the expected disulfide bridge (FIG. 8A). Moreover, a second double mutant was generated to evaluate the role of a basic amino acid at position 432 in the β20-β21 loop (prevalent in most non-Glade-A isolates) as an alternative salt-bridge partner for D113 in lieu of R429; as a spacer, the mutant was designed with a CG dipeptide inserted between amino acids 431 and 432 ($SOSIP_{113C-432CGins}$). Efficient formation of the expected disulfide bond was confirmed by MS also for the second mutant (FIG. 8B), thus validating the interchangeable function of positions 429 and 432 for mediating the interdomain interaction with D113. In an additional embodiment, the amino acid at position 432 was substituted with GCG, for form a D113C-X432GCG disulfide. In the context of a DU422 construct, this additional double mutant also displayed an antigenic profile consistent with trimeric HIV-1 Env in a prefusion mature conformation (FIG. 10).

Figure 1:
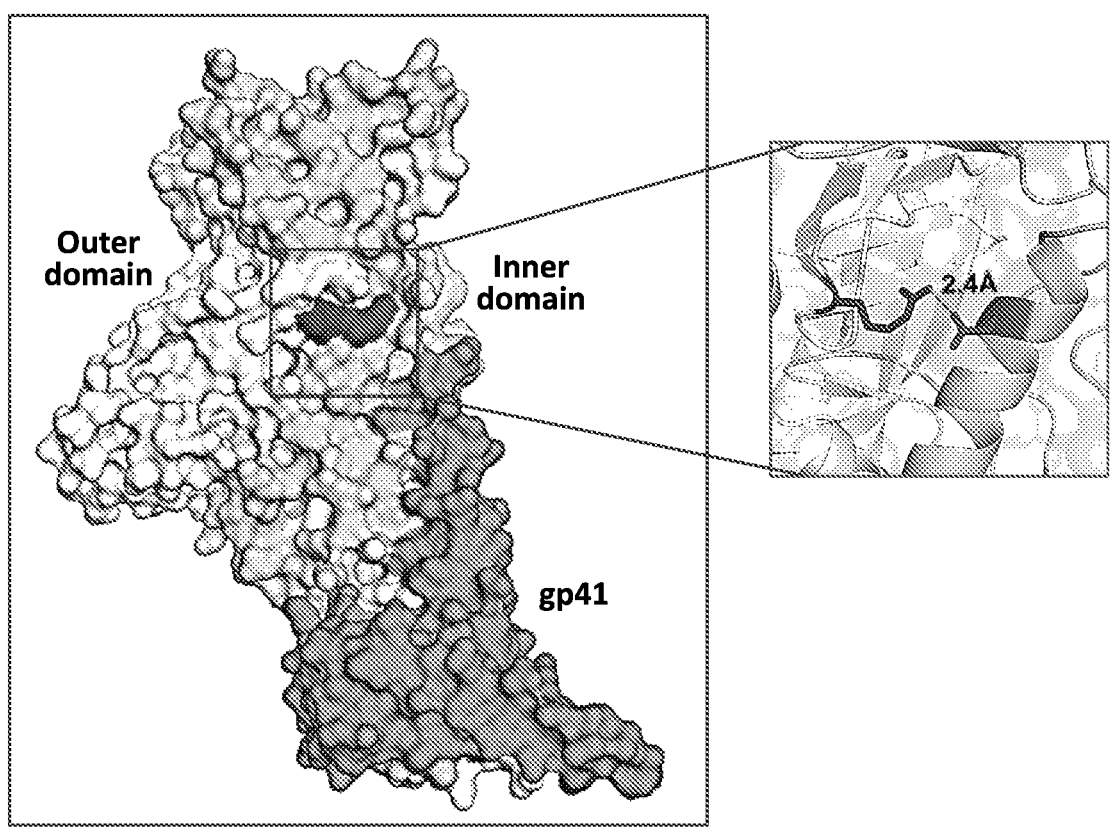
FIG. 1 is a space filling model of a single gp120-gp41 protomer of the HIV-1 Env ectodomain trimer. The outer and inner domains are indicated, with the proximity of the α1 helix and β20-β21 region highlighted and shown in the inset.
Figure 2B:
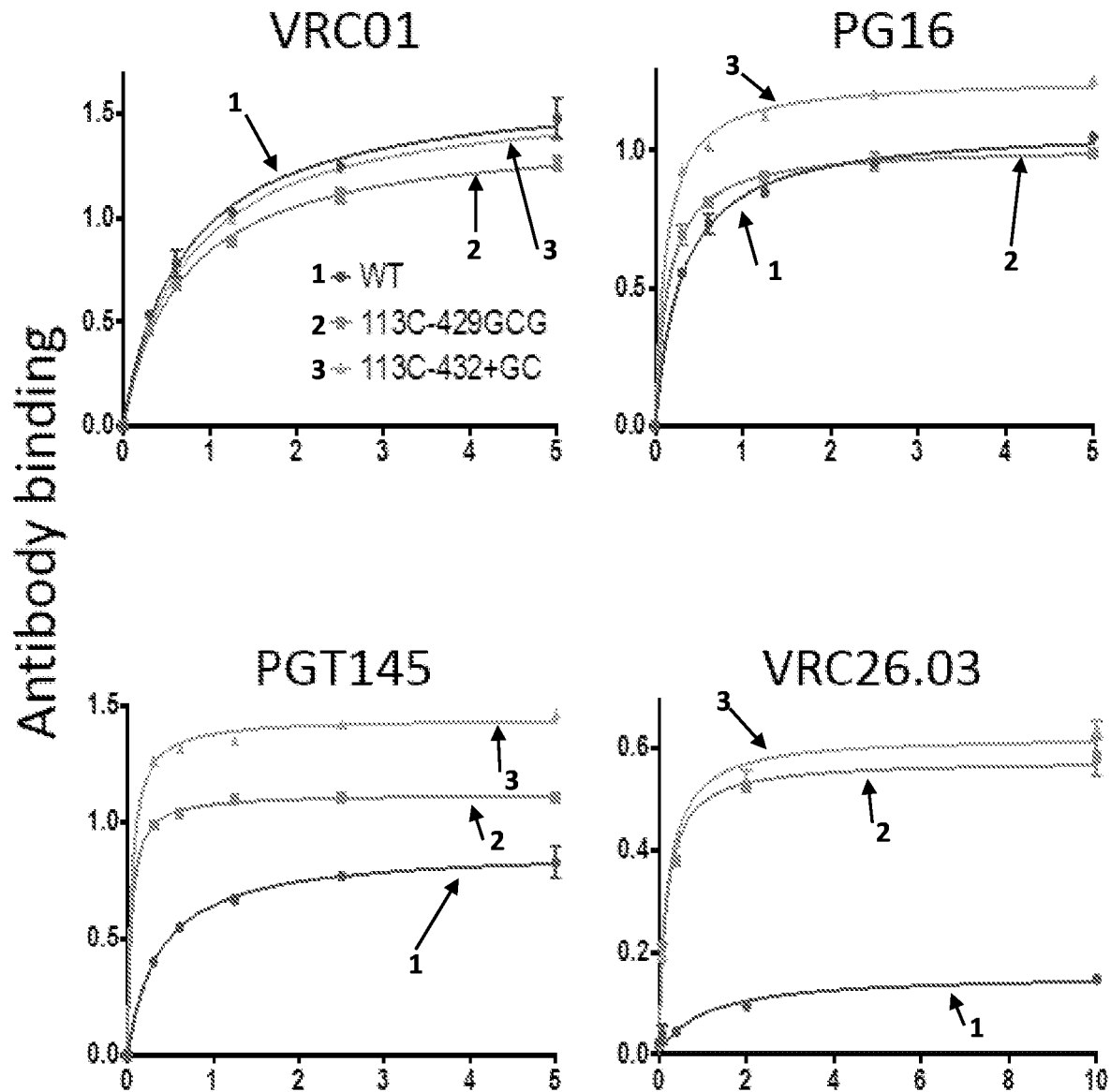

Interdomain locked SOSIP trimers display a restricted native-like antigenic profile. To evaluate whether the inter-domain neo-disulfide bridges effectively stabilized the envelope trimer in a native-like conformation, extensive antigenic profiling was performed on purified BG505-SOSIP.664 and DU422-SOSIP.664 trimers including the new disulfide locks. Both mutants displayed a restricted antigenic profile with preserved or even increased reactivity with broadly and potently neutralizing mAbs, while lacking reactivity with poorly or non-neutralizing mAbs, including those directed against CD4-induced (CD4i) epitopes tested either alone or in the presence of sCD4 (FIG. 2A). Of note, several broadly neutralizing antibodies, including the trimer-preferring mAbs, PGT145 and VRC26.03, recognized the locked mutants more efficiently than the WT trimer (FIGS. 2B, 10A, and 10B), indicating an increased stability of the quaternary epitopes at the tip of the trimer. These results indicated that the neo-disulfide locks effectively fixed the HIV-1 envelope trimer in a closed native structure preventing the transition to more open conformational states.

Figure 2C:
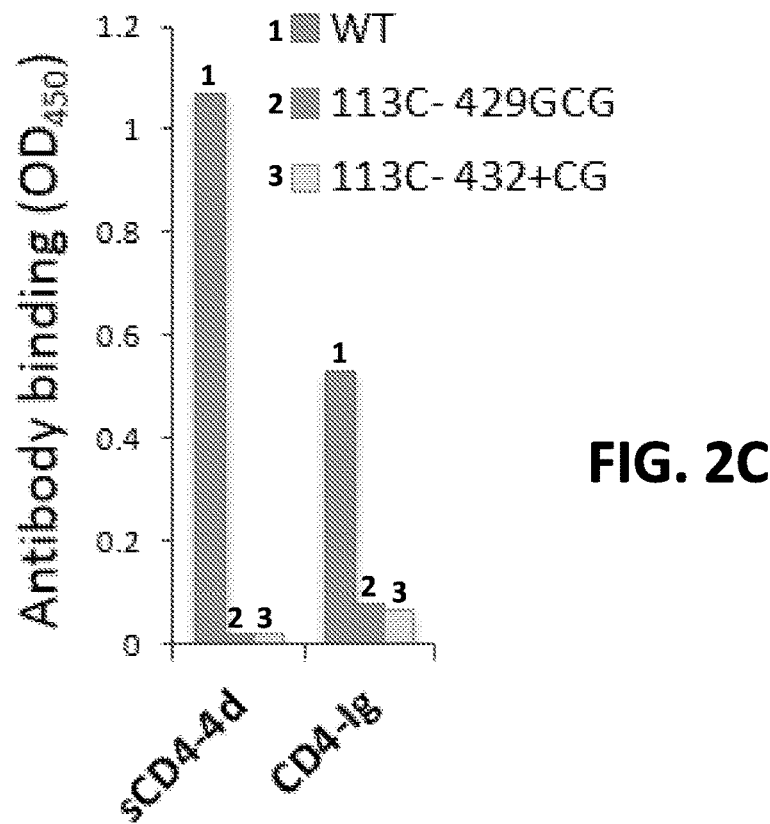
Figure 2D:
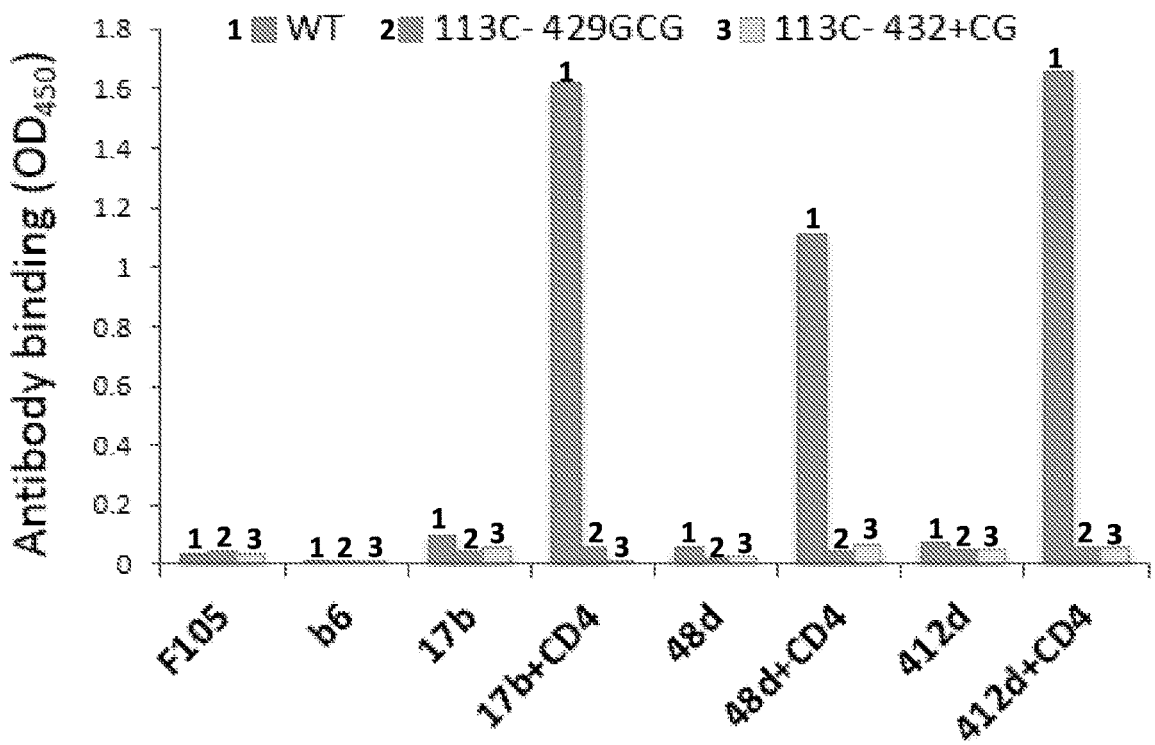

Interdomain neo-disulfide bridges abrogate CD4 binding. Binding of the HIV-1 envelope to the CD4 receptor is an energetically unfavorable process that requires significant conformational changes in gp120 (Kwong, Nature, 420, 678-682, 2002). This implies that a tightly locked trimer would bind minimally, if at all, to CD4. Unlike the WT BG505-SOSIP.664 trimer, the corresponding locked mutants were unable to bind 4-domain sCD4 in immunoassays (FIG. 2C), and the complete lack of CD4 interaction was confirmed by surface plasmon resonance (FIG. 2D). SPR detects real-time binding events with higher sensitivity than ELISA, confirming the fully locked status of the two mutants. It is remarkable that, despite the loss of CD4 binding, the epitopes for most broad and potent anti-CD4-binding-site mAbs remained accessible (FIG. 2A), confirming that potently neutralizing mAbs have been selected to interact with the native envelope without paying a significant entropic penalty (Kwong, Nature, 420, 678-682, 2002).

Figure 2E:
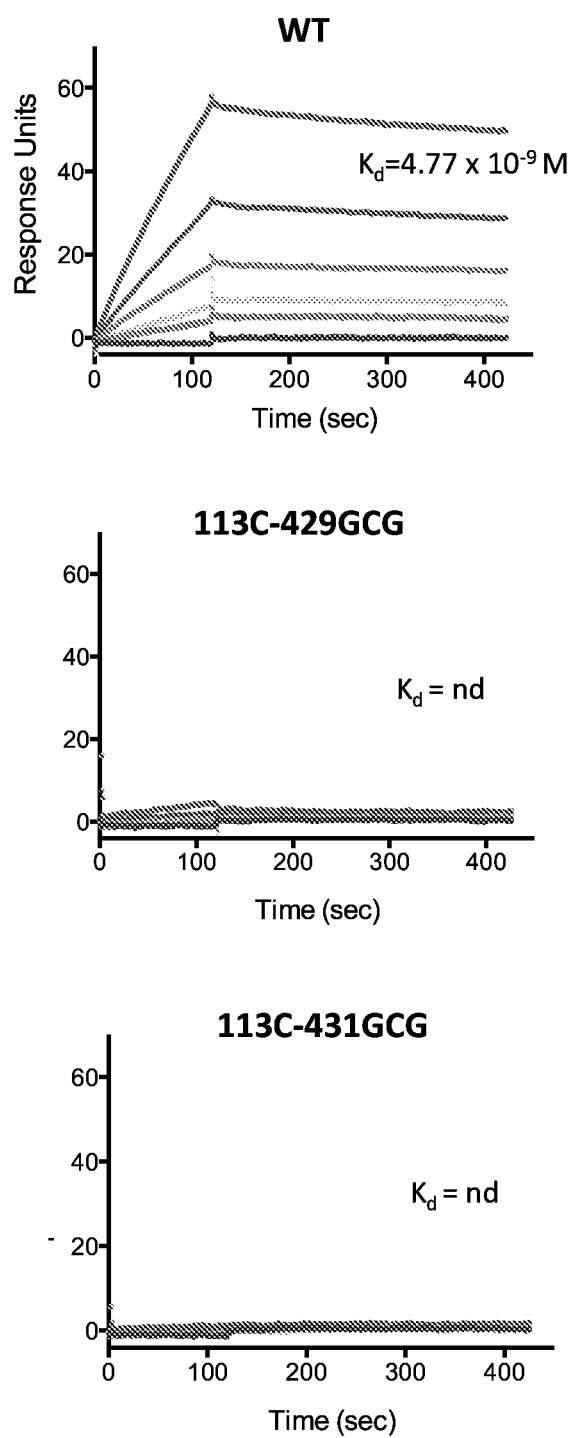
Figure 2F:
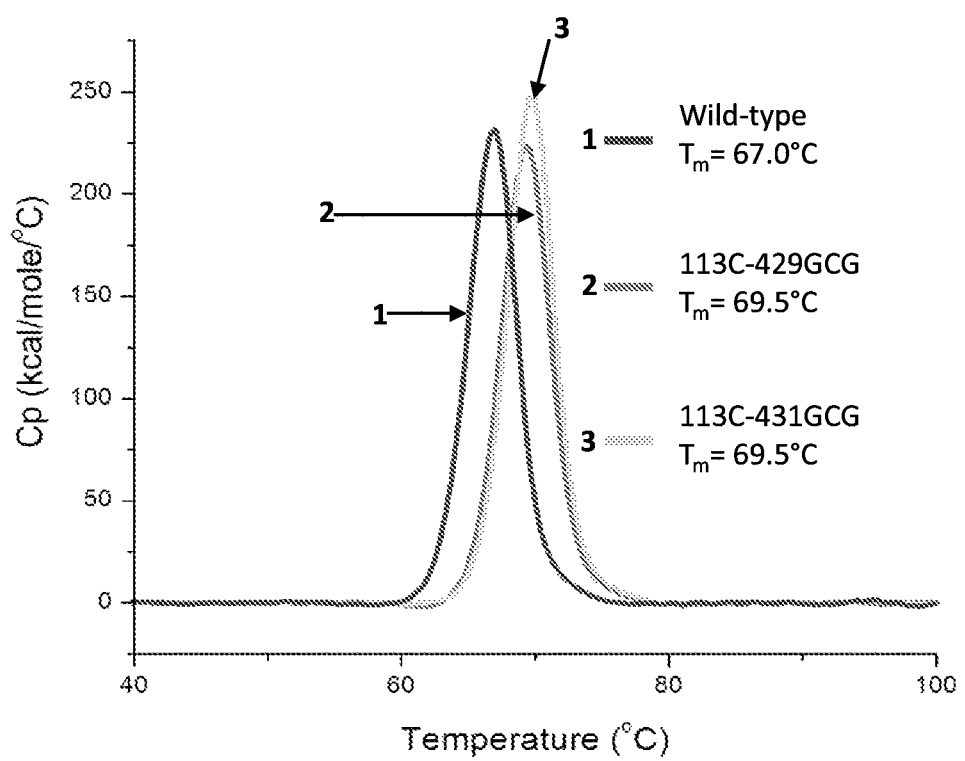
Figure 2G:
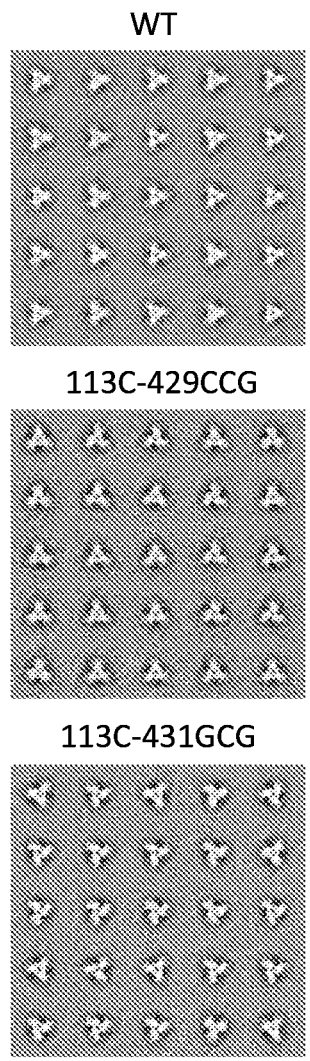
Figure 2H:
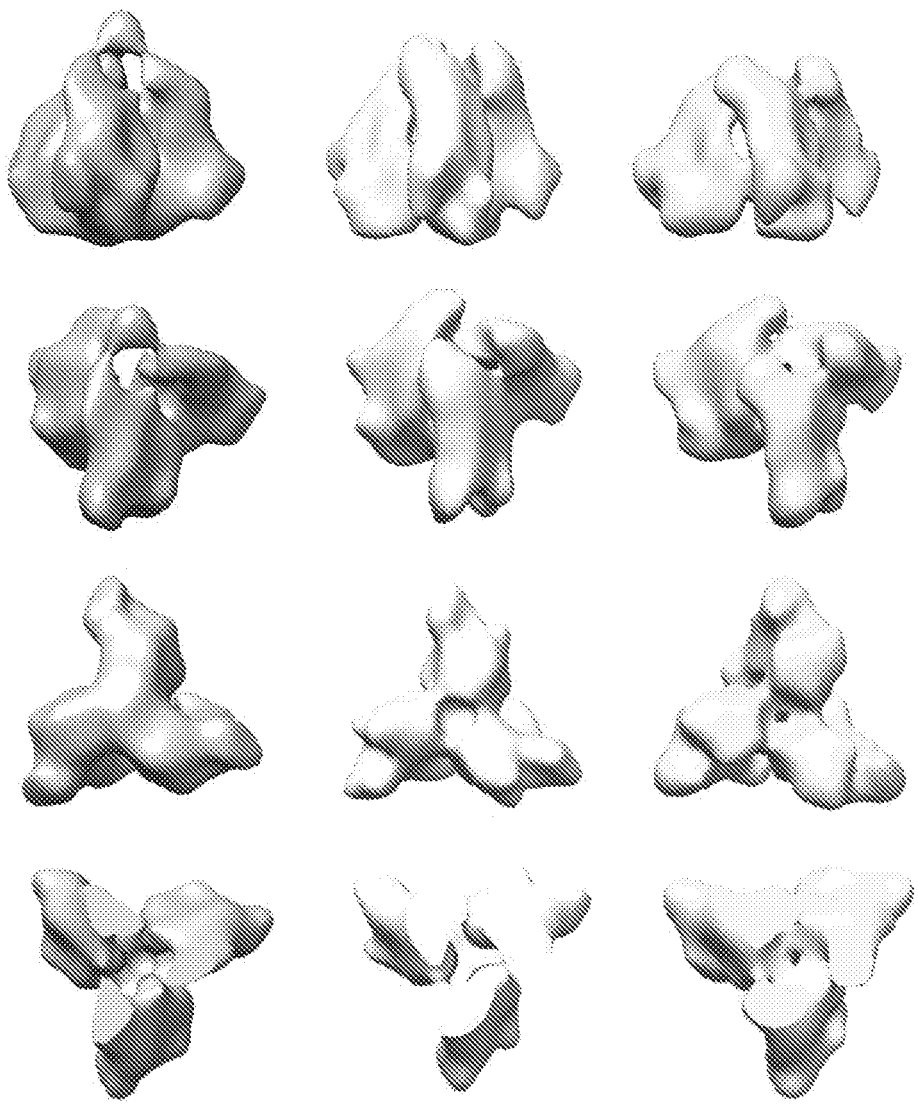

Biophysical characterization of the stabilized trimers. To further verify the structural stability of the locked soluble BG505-SOSIP.664 trimers, their thermal stability was characterized by DTC. Both mutated BG505-SOSIP.664 trimers showed an increased melting temperature, compared to the WT BG505-SOSIP.664 trimer (FIG. 2E).

Figure 3A:
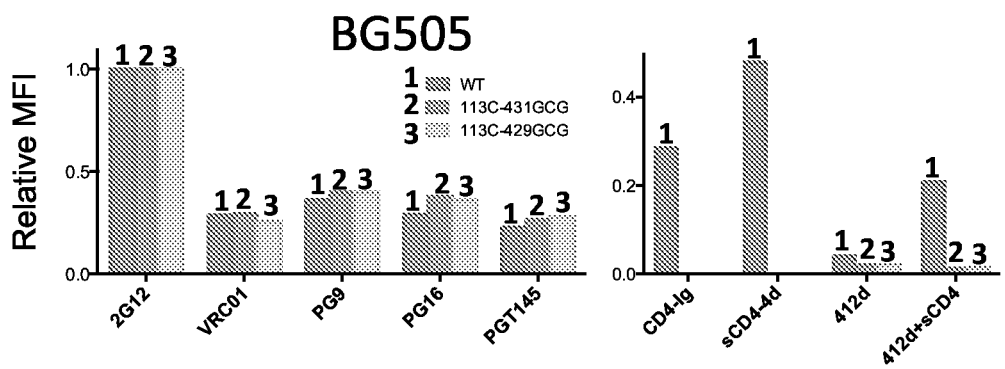
FIGS. 3A-3C illustrate the reactivity of cell surface-expressed wild-type (WT) and disulfide-bond stabilized HIV-1 envelope trimers with a panel of antibodies. Flow cytometry analysis of WT and mutated soluble HIV-1 Env trimers binding to broadly and potently neutralizing antibodies and poorly/non-neutralizing antibodies. Antibodies were tested at 2μg/ml. Results are shown for BG505-SOSIP.664 (FIG. 3A), BaL-SOSIP.664 (FIG. 3B) and JRFL-SOSIP.664 based trimers.
Figure 3B:
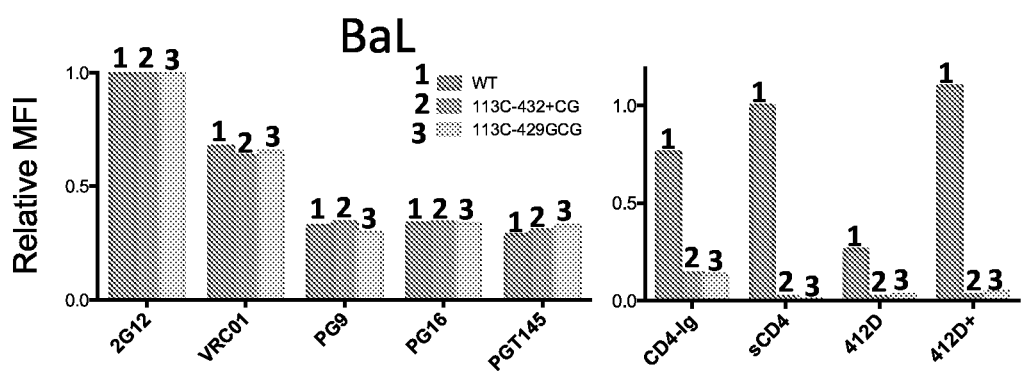
Figure 3B:
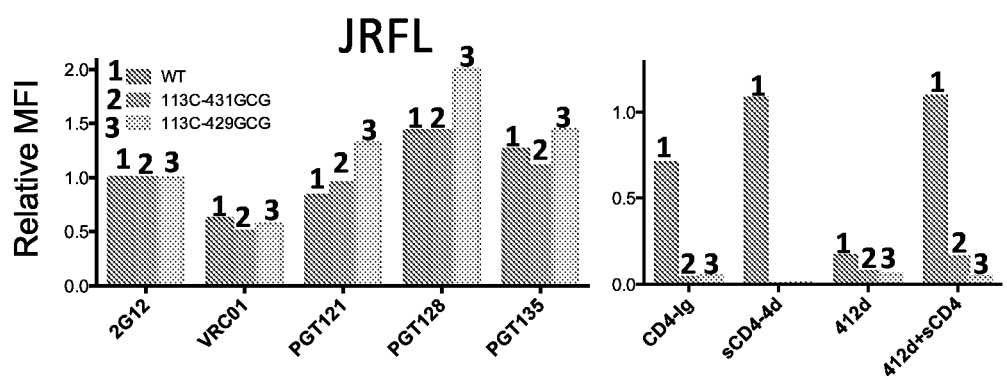
Figure 3C:
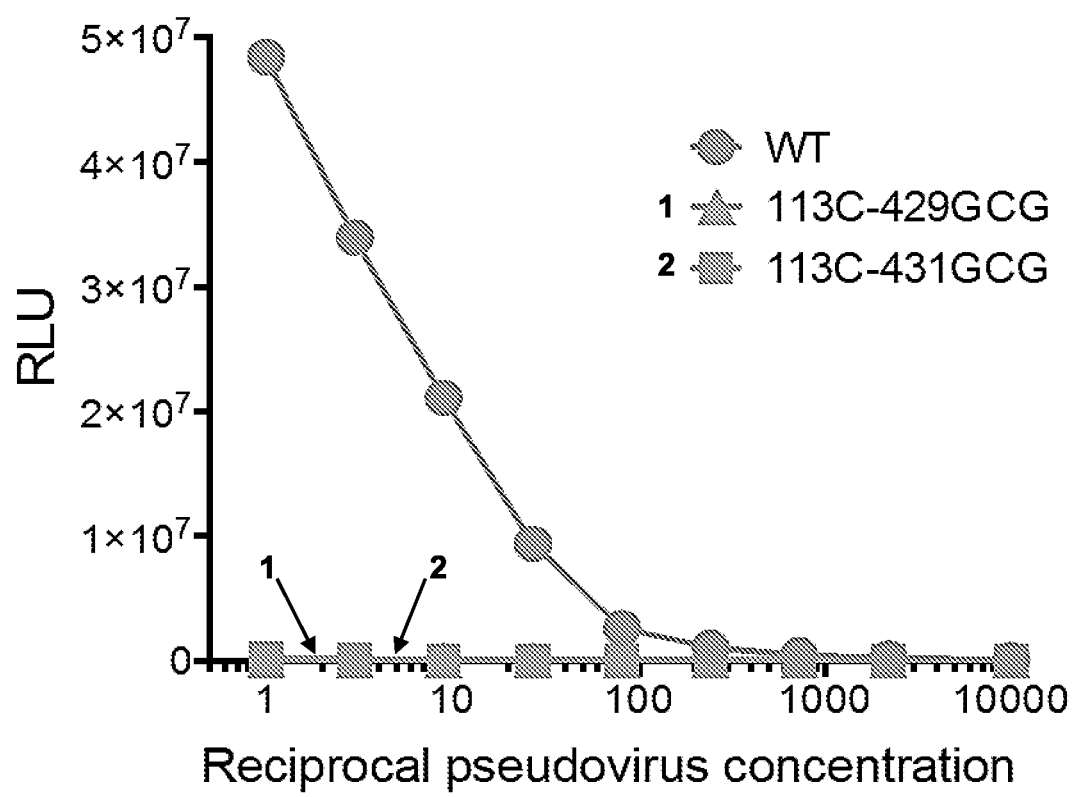

Interdomain neo-disulfide bridges effectively stabilize full-length envelopes from different HIV-1 isolates. Because the BG505-SOSIP.664 trimer is an artificially stabilized, truncated molecule that may not fully reflect the structure of the HIV-1 envelope spike, we investigated whether the same neo-disulfide bridges could successfully lock bona fide native trimers in a conformation that binds broadly neutralizing antibodies, but not CD4 (that is, the prefusion mature close conformation). Thus, the two double mutations were introduced into full-length gp160 from the homologous HIV-1 isolate (BG505) and the mutants were expressed in mammalian cells to verify their antigenic profile. Analysis of cell-surface-expressed envelope trimers by flow cytometry showed a consistent antigenic profile for both mutants, with preserved reactivity with broadly and potently neutralizing mAbs, and markedly reduced or abolished reactivity with non-neutralizing mAbs, as well as with sCD4 (FIG. 3A). To investigate whether the inter-domain locks could stabilize HIV-1 envelopes from diverse isolates and genetic clades, the same mutations were introduced in gp160 from two additional isolates (BaL and JR-FL, both Glade B). The results confirmed that the mutations effectively induced the locked phenotype in all the envelopes tested, irrespective of their genetic subtype (FIG. 3B). Consistent with the lack of interaction with the CD4 receptor, viral pseudoparticles expressing the locked envelopes from strain BG505 were totally devoid of infectious capacity (FIG. 3C).

Figure 4A:
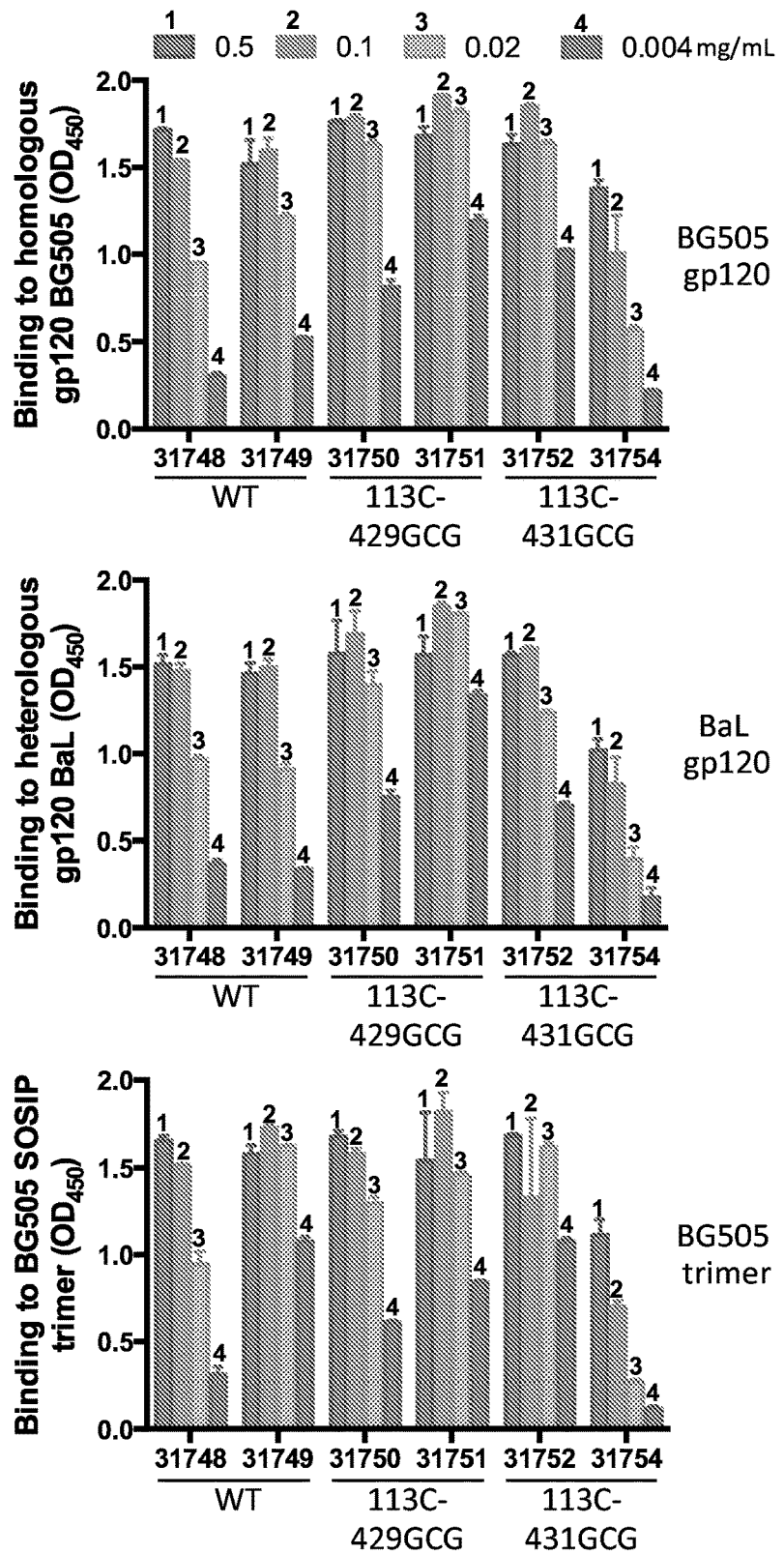
Figure 4B:
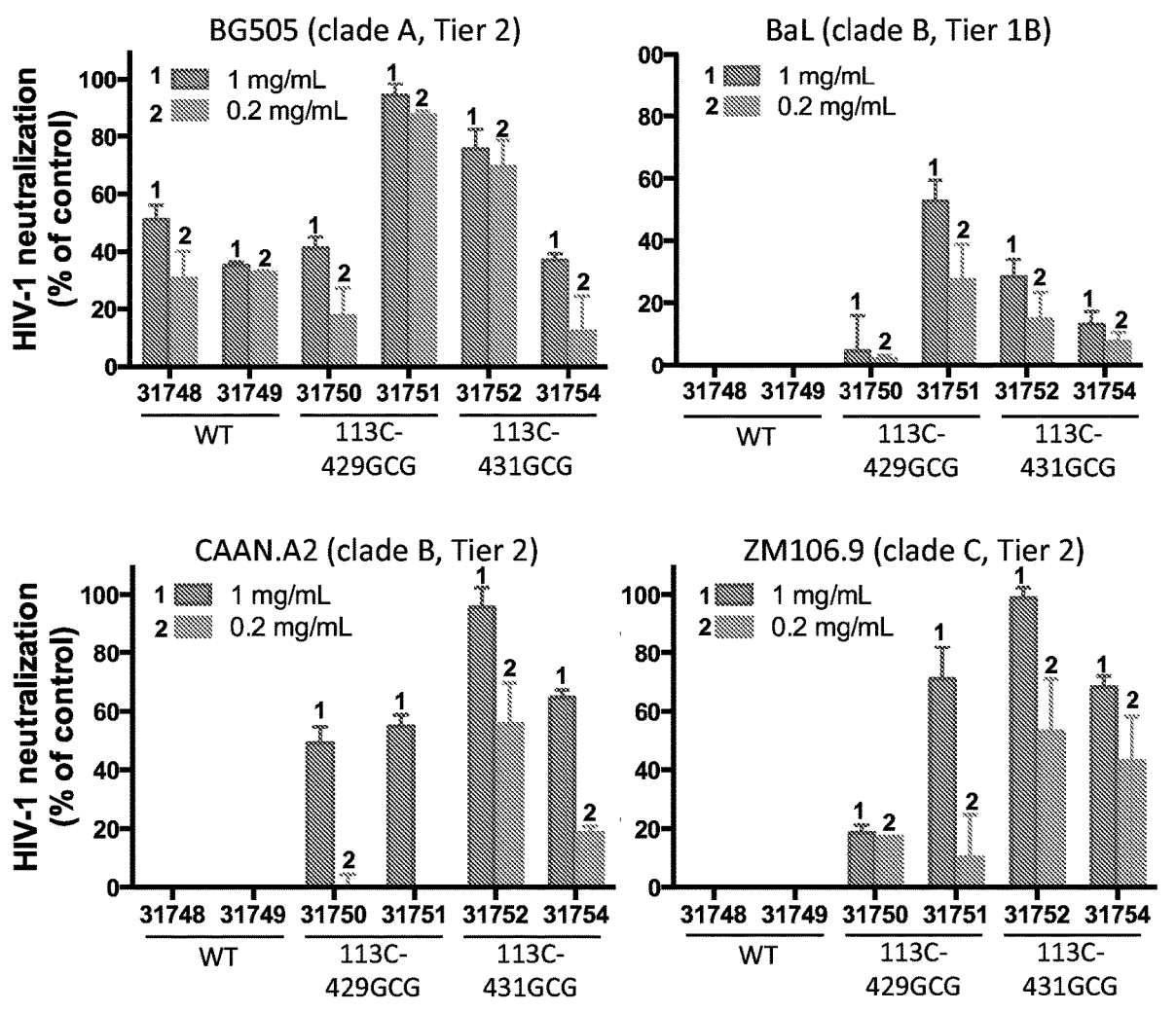
Figure 4C:
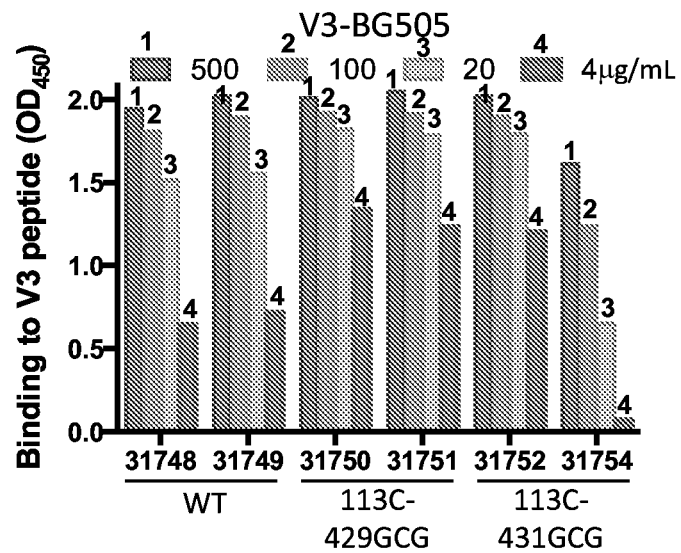
Figure 4C:
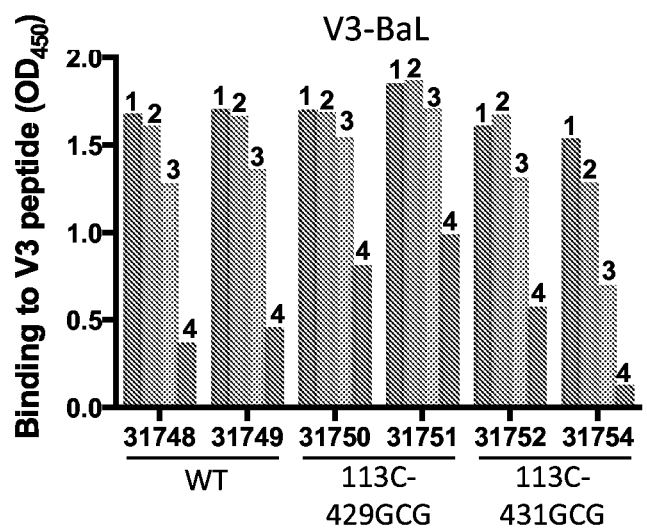

Prime-boost immunization of rabbits with stabilized HIV-1 envelope trimers. As the stabilized HIV-1 envelopes showed an antigenic profile of the prefusion mature closed HIV-1 Env spike, and were unable to bind CD4, they were assayed elicitation of antibodies against conserved epitopes displayed on the prefusion closed trimer. Thus, their immunogenicity was tested in rabbits using a DNA-prime/protein-boost protocol. HIV-1 gp160 DNA was delivered intramuscularly at week 0, 4 and 8 by in vivo electroporation through an AgilePulse system; protein boosts were administered subcutaneously at weeks 8, 12 and 16 using purified, 447-52D-depleted, BG505-SOSIP.664 trimers. Both the WT and the mutant trimers were highly immunogenic in rabbits, eliciting significant titer of antibodies to both autologous (BG505) and heterologous (BaL) gp120, as well as to the BG505-SOSIP.664 trimer (FIG. 4A). Neutralization assays showed that both WT and locked BG505-SOSIP.664 trimers induced Tier-2 neutralizing antibodies against the homologous strain, with two rabbits immunized with locked trimers exhibiting the highest neutralizing titers; strikingly, the two locked trimers but not the WT trimer were able to induce cross-Glade neutralizing antibodies against a tier-1B and a tier-2 Glade-B strains, as well as against a tier-2 Glade-C strain (FIG. 4B). Importantly, the neutralizing activity did not correlate with antibody titers against the V3 loop, as measured by ELISA on synthetic peptides containing either the autologous (BG505) or the heterologous (BaL) V3 sequence (FIG. 4C). These data demonstrate that the locking mutations effectively reduced access to epitopes for narrowly/non-neutralizing antibodies, but effectively presented to the immune system conserved epitopes targeted by broadly/potently-neutralizing antibodies, suggesting that blocking the inherent trimer flexibility can overcome one of the major immune evasion strategies of HIV-1.

An additional immunization assay was performed in rabbits using a DNA-prime/protein-boost protocol (FIG. 11). HIV-1 gp160 DNA was delivered intramuscularly at week 0, 4, 8, and 22 by in vivo electroporation through an AgilePulse system. Protein boosts were administered subcutaneously at weeks 8, 12, 16, and 22. This first round of immunizations was made with DNA (BG505 gp160 containing C and GCG substitutions at positions 113 and 429, 113C-429GCG) or purified BG505-SOSIP.664 trimers containing the 113C-429GCG mutation. Subsequent rounds of immunizations were then performed with heterologous Env. HIV-1 gp160 DNA was delivered intramuscularly at week 31 by in vivo electroporation through an AgilePulse system, and protein boosts were administered subcutaneously at weeks 34, 39, and 43. These rounds of immunizations were made with DNA (JR-FL gp160 containing C and GCG substitutions at positions 113 and 429, 113C-429GCG) or purified DU422-SOSIP.664 trimers containing the 113C-429GCG mutation. Neutralization of HIV-1 pseudoviruses bearing Env from different clades and tiers of neutralization sensitivity by sequential sera from an immunized rabbit is shown in FIG. 11B.

Discussion

The extraordinary flexibility of the HIV-1 envelope is one of the most effective immune evasion stratagems that HIV-1 has devised to impede the recognition of stable antigenic structures by the host immune system. This example provides new mutations for the production of stabilized HIV-1 envelopes from different genetic subtypes, which display a near-native antigenic profile associated with a markedly reduced molecular flexibility. Different approaches with a similar aim were recently used by other groups (Julien et al., *Science*, 342, 1477-1483, 2013; Garces et al., *Immunity*, 43, 1053-1063, 2015; Sanders et al., *PLoS Pathog.*, 9, e1003618, 2013; Lyumkis et al., *Science*, 342, 1484-1490, 2013), but their stabilization designs did not succeed in stabilizing the fully native structure, as shown by maintained ability to bind CD4 and undergo CD4-induced conformational changes, which might be an undesired feature in a native-like vaccine immunogen. In fact, binding to CD4 would result in sequestration of the immunogen by $CD4^+$ T cells, which are not good antigen-presenting cells, conformational alteration of the native structure, and occlusion of the CD4-binding site, which is a fundamental molecular target for the elicitation of protective antibodies. The lack of CD4 binding ability in the disclosed locked mutants may be related to the greater gain in stability that was achieved, guided by the molecular mimicry model based on the SLWDQ region of gp120, upon mutual anchoring of two fundamental pillars from the inner and outer domains, respectively, of the gp120 molecular core. In contrast, Kwon et al. (Julien et al., *Science*, 342, 1477-1483, 2013) anchored the outer domain to the flexible V1V2 loop structures at the tip of the trimer, while deTaeye et al. (Lyumkis et al., *Science*, 342, 1484-1490, 2013) used a mutagenesis strategy that seemed to bolster pre-existing intra-molecular interactions without creating inter-domain staples to reduce the reciprocal mobility of the two major gp120 domains.

Because the disclosed locked envelopes are stabilized in a rigid native structure that selectively presents epitopes recognized by broadly and potently neutralizing antibodies, they represent useful components of an HIV-1 vaccine. In fact, the immunization studies demonstrated for the first time the induction of cross-clade tier-2 neutralization, an objective that was not achieved in previous studies, including recent ones with partially stabilized trimers (Julien et al., *Science*, 342, 1477-1483, 2013; Pancera et al., *Nature*, 514, 455-461, 2014; Kwon et al., *Nat. Struct. Mol. Biol.*, 22, 522-531, 2015; Garces et al., *Immunity*, 43, 1053-1063, 2015; Sanders et al., *PLoS Pathog.*, 9, e1003618, 2013; Lyumkis et al., *Science*, 342, 1484-1490, 2013). These results show that the selective presentation of conserved neutralization epitopes in the context of a conformationally stable protein framework can overcome one of the most important immune evasion strategies enacted by HIV-1 and effectively elicit the production of broad and potent neutralizing antibodies, raising new hope for the design of a protective HIV-1 vaccine.

BG505 SOSIP.664 expression, purification and deglycosylation. BG505 SOSIP.664 trimer was produced in HEK 293 Free-Style cells via transient transfection of the BG505 SOSIPexpressing plasmid with furin and purified over a lectin affinity column (GNA agarose, Vector Laboratories) followed by gel filtration over a size-exclusion chromatography (Superdex-200 16/60 column (GE Healthcare). The eluted protein was dialyzed against PBS and further purified by negative affinity chromatography with a V3 loop-specific monoclonal antibody, 447-52D, to remove aberrant trimer species. After elution, the protein was dialyzed again against PBS.

A human clinical trial might be conducted using a viral vector-encoded gp160 as a prime and adjuvanted protein (trimeric Ectodomain) as booster, similar to the protocol used for the RV144 vaccine trial in Thailand (Rerks-Ngarm et al., NEJM 361: 2209, 2009). Specifically, the study vaccines will be administered at baseline (day 0), 4 weeks (pre-specified range, 3 to 7), 12 weeks (range, 10 to 15), and 24 weeks (range, 21 to 28). The vectored gp160 (e.g., ALVAC-HIV) vaccine will be administered at each of the four visits. Boosting with SOSIP protein will occur at weeks 12 and 24.

SEQUENCE LISTING (118 sequences)

SEQ ID NO: 1 - protein, 856 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 2 - protein, 860 aa, Human immunodeficiency virus
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 3 - protein, 845 aa, Human immunodeficiency virus
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWDQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGQAMYAPPIQGVIRCESNITGLLLTRDGGNNNTNETFRPGGGDMRDNWRSELYKYKVVKIEPLGVAPTRAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLWYIKIFIMIVGGLIGLRIVFAVLSVINRVRQGYSPLSFQTHTPNPRGLDRPGRIEEEGGEQGRDRSIRLVSGFLALAWDDLRSLCLFSYHRLRDFILIAARTVELLGHSSLKGLRLGWEGLKYLWNLLLYWGRELKISAINLVDTIAIAVAGWTDRVIEIGQRIGRAILHIPRRIRQGLERALL

SEQ ID NO: 4 - protein, 843 aa, Human immunodeficiency virus
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWDQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGRAMYAPPIAGVIKCTSNITGIILTRDGGNNETETFRPGGGDMRDNWRSELYKYKVVKIEPLGVAPTRAKRRVVEREKRAVGMGAVFLGFLGAAGSTMGAASITLTVQARQLLSGIVQQQSNLLKAIEAQQHLLKLTVWGIKQLQARVLALERYLQDQQLLGIWGCSGKLICATTVPWNSSWSNKTQEEIWNNMTWLQWDKEISNYTNIIYKLLEESQNQQEKNEQDLLALDKWANLWNWFNITNWLWYIRIFIMIVGGLIGLRIVIAIISVVNRVRQGYSPLSFQIPTPNPEGLDRPGRIEEGGGEQGRDRSIRLVSGFLALAWDDLRSLCLFSYHRLRDCILIAARTVELLGHSSLKGLRLGWEGLKYLWNLLLYWGRELKNSAISLLDTIAVAVAEWTDRVIEIGQRACRAILNIPRRIRQGFERALL

SEQ ID NO: 5 - protein, 841 aa, Human immunodeficiency virus
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGKAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 6 - protein, 835 aa, Human immunodeficiency virus
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWDQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGRAMYAPPIAGNITCKSNITGLLLTRDGGKNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 7 - protein, 840 aa, Human immunodeficiency virus
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWDQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGKAMYAPPIEGLIKCSSNITGLLLTRDGGANNSHNETFRPGGGDMRDNWRSELYKYKVVKIEPLGVAPTRAKRRVVEREKRAIGLGAMFLGFLGAAGSTMGAASMTLTVQARQLLSGIVQQQNNLLRAIEAQQHLLQLTVWGIKQLQARILAVERYLKDQQLLGIWGCSGKHICTTTVPWNSSWSNKSLDEIWNNMTWMEWEREIDNYTGLIYSLIEESQNQQEKNEQELLELDKWASLWNWFSITQWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIAARIVELLGRRGWEALKYLWNLLQYWIQELKNSAISLFDTTAIAVAEGTDRVIEIVQRACRAILNIPTRIRQGLERALL

SEQ ID NO: 8 - protein, 832 aa, Human immunodeficiency virus
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWDQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGRAMYAAPIAGNITCNSNITGLLLTRDGGQNNTETFRPGGGNMKDNWRSELYKYKVVEIEPLGVAPTKAKRQVVKRERRAVGIGAVFLGFLGAAGSTMGAASITLTVQARQLLSGIVQQQNNLLRAIEAQQHLLQLTVWGIKQLQARVLAVERYLKDQQLLGLWGCSGKLICTTNVPWNSSWSNKSQDEIWNNMTWMEWEKEISNYSNIIYRLIEESQNQQEKNEQELLALDKWASLWNWFDISNWLWYIKIFIMIVGGLIGLRIVFAVLSIVNRVRKGYSPLSLQTLIPSPREPDRPEGIEEGGGEQGKDRSVRLVNGFLALVWDDLRNLCLFSYRHLRDFILIAARIVDRGLRRGWEALKYLGNLTQYWSQELKNSAISLLNTTAIVVAEGTDRVIEALQRAGRAVLNIPRRIRQGLERALL

SEQ ID NO: 9 - protein, 831 aa, Human immunodeficiency virus
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWDQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGRAMYAPPIAGQIQCNSNITGLLLTRDGGKNGSETLRPGGGDMRDNWRSELYKYKVVKIEPLGVAPTKAKRQVVQREKRAVGIGAVLLGFLGAAGSTMGAASITLTVQARQLLSGIVQQQSNLLKAIEAQQHLLQLTVWGIKQLQARILAVERYLKDQQLLGIWGCSGKLICTTNVPWNSSWSNKSQDEIWDNMTWMQWEKEISNYTDTIYRLIEDAQNQQEKNEQDLLALDKWDNLWSWFTITNWLWYIKIFIMIVGGLIGLRIVFAVLSVVNRVRQGYSPLSLQTLIPNPRGPERPGGIEEEGGEQDRDRSIRLVSGFLALAWDDLRSLCLFSYRHLRDFILIAARTVDMGLKRGWEALKYLWNLPQYWGQELKNSAISLLDTTAIAVAEGTDRIIEVLQRAGRAVLHIPRRIRQGFERALL

SEQ ID NO: 10 - protein, 847 aa, Human immunodeficiency virus
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 11 - protein, 855 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWDQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQKVGRAMYAPPIRGQIRCSSNITGLLLTRDGGPEDNKTEVFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQHLLQLTVWGIKQLQARVLAVERYLRDQQLLGIWGCSGKLICTTAVPWNASWSNKSLNKIWDNMTWMEWDREINNYTSIIYSLIEESQNQQEKNEQELLELDKWASLWNWFEITEWLWYIKIFIMIIGGLIGLRIVFSVLSIMNRVRQGYSPLSFQTHLPASRGPDRPGGIEEEGGERDRDRSGRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 12 - protein, 854 aa, Human immunodeficiency virus
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQKVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGAASMTLTVQARQLLSDIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSIVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVNLLNATAIAVAEGTDRVIEVLQAAYRAIRHIPRRIRQGLERILL

SEQ ID NO: 13 - protein, 868 aa, Human immunodeficiency virus
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWDQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQEVGKAMYAPPIRGQINCSSNITGLLLTRDGGESNKTIEVFRPGGGDMRDNWRSELYKYKVVKIEPLGVAPTKAKRRVVQREKRAVGLGALFVGFLGAAGSTMGAASITLTVQARQLLSGIVQQQNNLLRAIEAQQHLLQLTVWGVKQLQARVLAVERYLKDQQLLGLWGCSGKLICTTAVPWNTSWSNKSYDYIWDNMTWMQWEREIDNYTGVIYKLIEESQNQQEKNEQELLALDKWANLWNWFDITRWLWYIKIFIMIVGGLVGLRIVFAVLSIVNRVRQGYSPLSLQTHFPAPRGPDRPEGTEEEGGDRDRDRSTPLVDGFLAIIWVDLRSLFLFSYHRLRDLLLIVTRIVELLGRRGWEALKYWWNLLQYWSQELRNSAVSLFNATAIAVAEGTDRVIEAVQRIGRAILHIPRRIRQGFERALQ

SEQ ID NO: 14 - protein, 877 aa, Human immunodeficiency virus
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVEIKPLGIAPTSAKRRVVEREKRAAGIGAVILGFLGAAGSTMGAASVMLTVQARQLLSGIVQQQSNLLRAIEAQQHMLQLTVWGIKQLQTRVLAIERYLKDQQLLGLWGCSGKLICTTAVPWNTSWSNKSKDEIWDNMTWMQWDREIDNYTQVIYQLLEVSQNQQEKNENDLLALDKWNSLWSWFDITKWLWYIKIFIMIVGGLIGLRIIFAVLSVVNRVRQGYSPLSFQTLIPNPRGPDRPGGIEEEGGEQDKNRSTRLVSGFLALVWDDLRSLCLFSYHRLRDFILIAARAVELLGRSSLEGLQWGWETLKYLRNLVQYWGLELKQSAINLLDTIAIQVAEGTDRIIELIQRIFRAICNIPTRIRQGFEAALQ

SEQ ID NO: 15 - protein, 858 aa, Human immunodeficiency virus
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALL

SEQ ID NO: 16 - protein, 10 aa, Artificial Sequence
  Peptide linker
GGSGGGGSGG

SEQ ID NO: 17 - protein, 457 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 18 - protein, 27 aa, Human immunodefociency virus
KIFIMIVGGLIGLRIVFAVLSVIHRVR

SEQ ID NO: 19 - protein, 23 aa, Artificial Sequence
  Influenza A Hemagglutinin TM domain
ILAIYSTVASSLVLLVSLGAISF

SEQ ID NO: 20 - protein, 29 aa, Artificial Sequence
  Influenza A Neuraminidase TM domain
IITIGSICMVVGIISLILQIGNIISIWVS

SEQ ID NO: 21 - protein, 26 aa, Artificial Sequence
  T4 fibritin Foldon domain
GYIPEAPRDGQAYVRKDGEWVLLSTF

SEQ ID NO: 22 - protein, 858 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQGCGVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 23 - protein, 858 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGCGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 24 - protein, 666 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQGCGVGKAMYAPPISGQIRCSSNITGLLLTRDGGNSNNESEIFRPGGGDMRDNWRSELYKYKVVKIEPLGVAPTKCKRRVVQREKRAVGIGALFLGFLGAAGSTMGAASMTLTVQARQLLSGIVQQQNNLLRAPEAQQHLLQLTVWGIKQLQARILAVERYLKDQQLLGIWGCSGKLICCTAVPWNASWSNKSLEQIWNHTTWMEWDREINNYTSLIHSLIEESQNQQEKNEQELLELD

SEQ ID NO: 25 - protein, 666 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGCGKAMYAPPISGQIRCSSNITGLLLTRDGGNSNNESEIFRPGGGDMRDNWRSELYKYKVVKIEPLGVAPTKCKRRVVQREKRAVGIGALFLGFLGAAGSTMGAASMTLTVQARQLLSGIVQQQNNLLRAPEAQQHLLQLTVWGIKQLQARILAVERYLKDQQLLGIWGCSGKLICCTAVPWNASWSNKSLEQIWNHTTWMEWDREINNYTSLIHSLIEESQNQQEKNEQELLELD

SEQ ID NO: 26 - protein, 862 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQGCGIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 27 - protein, 862 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGCGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 28 - protein, 663 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQGCGIGQAMYAPPIQGVIRCVSNITGLILTRDGGSTNSTTETFRPGGGDMRDNWRSELYKYKVVKIEPLGVAPTRCKRRVVGREKRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 29 - protein, 663 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGCGQAMYAPPIQGVIRCVSNITGLILTRDGGSTNSTTETFRPGGGDMRDNWRSELYKYKVVKIEPLGVAPTRCKRRVVGREKRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 30 - protein, 847 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQGCGAGQAMYAPPIQGVIRCESNITGLLLTRDGGNNNTNETFRPGGGDMRDNWRSELYKYKVVKIEPLGVAPTRAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLWYIKIFIMIVGGLIGLRIVFAVLSVINRVRQGYSPLSFQTHTPNPRGLDRPGRIEEEGGEQGRDRSIRLVSGFLALAWDDLRSLCLFSYHRLRDFILIAARTVELLGHSSLKGLRLGWEGLKYLWNLLLYWGRELKISAINLVDTIAIAVAGWTDRVIEIGQRIGRAILHIPRRIRQGLERALL

SEQ ID NO: 31 - protein, 847 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGCGQAMYAPPIQGVIRCESNITGLLLTRDGGNNNTNETFRPGGGDMRDNWRSELYKYKVVKIEPLGVAPTRAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLWYIKIFIMIVGGLIGLRIVFAVLSVINRVRQGYSPLSFQTHTPNPRGLDRPGRIEEEGGEQGRDRSIRLVSGFLALAWDDLRSLCLFSYHRLRDFILIAARTVELLGHSSLKGLRLGWEGLKYLWNLLLYWGRELKISAINLVDTIAIAVAGWTDRVIEIGQRIGRAILHIPRRIRQGLERALL

SEQ ID NO: 32 - protein, 648 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQGCGAGQAMYAPPIQGVIRCESNITGLLLTRDGGNNNTNETFRPGGGDMRDNWRSELYKYKVVKIEPLGVAPTRCKRRVVEREKRAVGIGAVFLGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSQNEIWDNMTWLQWDKEISNYTHIIYNLIEESQNQQEKNEQDLLALD

SEQ ID NO: 33 - protein, 648 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGCGQAMYAPPIQGVIRCESNITGLLLTRDGGNNNTNETFRPGGGDMRDNWRSELYKYKVVKIEPLGVAPTRCKRRVVEREKRAVGIGAVFLGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSQNEIWDNMTWLQWDKEISNYTHIIYNLIEESQNQQEKNEQDLLALD

SEQ ID NO: 34 - protein, 845 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQGCGVGRAMYAPPIAGVIKCTSNITGIILTRDGGNNETETFRPGGGDMRDNWRSELYKYKVVKIEPLGVAPTRAKRRVVEREKRAVGMGAVFLGFLGAAGSTMGAASITLTVQARQLLSGIVQQQSNLLKAIEAQQHLLKLTVWGIKQLQARVLALERYLQDQQLLGIWGCSGKLICATTVPWNSSWSNKTQEEIWNNMTWLQWDKEISNYTNIIYKLLEESQNQQEKNEQDLLALDKWANLWNWFNITNWLWYIRIFIMIVGGLIGLRIVIAIISVVNRVRQGYSPLSFQIPTPNPEGLDRPGRIEEGGGEQGRDRSIRLVSGFLALAWDDLRSLCLFSYHRLRDCILIAARTVELLGHSSLKGLRLGWEGLKYLWNLLLYWGRELKNSAISLLDTIAVAVAEWTDRVIEIGQRACRAILNIPRRIRQGFERALL

SEQ ID NO: 35 - protein, 845 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGCGRAMYAPPIAGVIKCTSNITGIILTRDGGNNETETFRPGGGDMRDNWRSELYKYKVVKIEPLGVAPTRAKRRVVEREKRAVGMGAVFLGFLGAAGSTMGAASITLTVQARQLLSGIVQQQSNLLKAIEAQQHLLKLTVWGIKQLQARVLALERYLQDQQLLGIWGCSGKLICATTVPWNSSWSNKTQEEIWNNMTWLQWDKEISNYTNIIYKLLEESQNQQEKNEQDLLALDKWANLWNWFNITNWLWYIRIFIMIVGGLIGLRIVIAIISVVNRVRQGYSPLSFQIPTPNPEGLDRPGRIEEGGGEQGRDRSIRLVSGFLALAWDDLRSLCLFSYHRLRDCILIAARTVELLGHSSLKGLRLGWEGLKYLWNLLLYWGRELKNSAISLLDTIAVAVAEWTDRVIEIGQRACRAILNIPRRIRQGFERALL

SEQ ID NO: 36 - protein, 646 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQGCGVGRAMYAPPIAGVIKCTSNITGIILTRDGGNNETETFRPGGGDMRDNWRSELYKYKVVKIEPLGVAPTRCKRRVVEREKRAVGMGAVFLGFLGAAGSTMGAASITLTVQARQLLSGIVQQQSNLLKAPEAQQHLLKLTVWGIKQLQARVLALERYLQDQQLLGIWGCSGKLICCTTVPWNSSWSNKTQEEIWNNMTWLQWDKEISNYTNIIYKLLEESQNQQEKNEQDLLALD

SEQ ID NO: 37 - protein, 646 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGCGRAMYAPPIAGVIKCTSNITGIILTRDGGNNETETFRPGGGDMRDNWRSELYKYKVVKIEPLGVAPTRCKRRVVEREKRAVGMGAVFLGFLGAAGSTMGAASITLTVQARQLLSGIVQQQSNLLKAPEAQQHLLKLTVWGIKQLQARVLALERYLQDQQLLGIWGCSGKLICCTTVPWNSSWSNKTQEEIWNNMTWLQWDKEISNYTNIIYKLLEESQNQQEKNEQDLLALD

SEQ ID NO: 38 - protein, 843 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQGCGVGKAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 39 - protein, 843 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGCGKAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 40 - protein, 651 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQGCGVGKAMYAPPIRGQIRCSSNITGLLLTRDGGNNETEIFRPGGGDMRDNWRSELYKYKVVKIEPLGVAPTKCKRRVVQREKRAVGIGAMFLGFLGAAGSTMGAASMTLTVQARQLLSGIVQQQNNLLRAPEAQQHLLQLTVWGIKQLQARVLAVERYLKDQQLLGIWGCSGKLICCTAVPWNASWSNKSLDEIWDNMTWMEWEREIDNYTSLIYTLIEESQNQQEKNEQELLELD

SEQ ID NO: 41 - protein, 651 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGCGKAMYAPPIRGQIRCSSNITGLLLTRDGGNNETEIFRPGGGDMRDNWRSELYKYKVVKIEPLGVAPTKCKRRVVQREKRAVGIGAMFLGFLGAAGSTMGAASMTLTVQARQLLSGIVQQQNNLLRAPEAQQHLLQLTVWGIKQLQARVLAVERYLKDQQLLGIWGCSGKLICCTAVPWNASWSNKSLDEIWDNMTWMEWEREIDNYTSLIYTLIEESQNQQEKNEQELLELD

SEQ ID NO: 42 - protein, 837 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQGCGVGRAMYAPPIAGNITCKSNITGLLLTRDGGKNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 43 - protein, 837 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGCGRAMYAPPIAGNITCKSNITGLLLTRDGGKNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 44 - protein, 638 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQGCGVGRAMYAPPIAGNITCKSNITGLLLTRDGGKNNTETFRPGGGDMRDNWRSELYKYKVVEIKPLGIAPTKCKRRVVEREKRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNKSQEDIWDNMTWMQWDREISNYTDTIYRLLEDSQNQQEKNEKDLLALD

SEQ ID NO: 45 - protein, 638 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGCGRAMYAPPIAGNITCKSNITGLLLTRDGGKNNTETFRPGGGDMRDNWRSELYKYKVVEIKPLGIAPTKCKRRVVEREKRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNKSQEDIWDNMTWMQWDREISNYTDTIYRLLEDSQNQQEKNEKDLLALD

SEQ ID NO: 46 - protein, 842 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGCGVGKAMYAPPIEGLIKCSSNITGLLLTRDGGANNSHNETFRPGGGDMRDNWRSELYKYKVVKIEPLGVAPTRAKRRVVEREKRAIGLGAMFLGFLGAAGSTMGAASMTLTVQARQLLSGIVQQQNNLLRAIEAQQHLLQLTVWGIKQLQARILAVERYLKDQQLLGIWGCSGKHICTTTVPWNSSWSNKSLDEIWNNMTWMEWEREIDNYTGLIYSLIEESQNQQEKNEQELLELDKWASLWNWFSITQWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIAARIVELLGRRGWEALKYLWNLLQYWIQELKNSAISLFDTTAIAVAEGTDRVIEIVQRACRAILNIPTRIRQGLERALL

SEQ ID NO: 47 - protein, 842 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGCGKAMYAPPIEGLIKCSSNITGLLLTRDGGANNSHNETFRPGGGDMRDNWRSELYKYKVVKIEPLGVAPTRAKRRVVEREKRAIGLGAMFLGFLGAAGSTMGAASMTLTVQARQLLSGIVQQQNNLLRAIEAQQHLLQLTVWGIKQLQARILAVERYLKDQQLLGIWGCSGKHICTTTVPWNSSWSNKSLDEIWNNMTWMEWEREIDNYTGLIYSLIEESQNQQEKNEQELLELDKWASLWNWFSITQWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIAARIVELLGRRGWEALKYLWNLLQYWIQELKNSAISLFDTTAIAVAEGTDRVIEIVQRACRAILNIPTRIRQGLERALL

SEQ ID NO: 48 - protein, 650 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGCGVGKAMYAPPIEGLIKCSSNITGLLLTRDGGANNSHNETFRPGGGDMRDNWRSELYKYKVVKIEPLGVAPTRCKRRVVEREKRAIGLGAMFLGFLGAAGSTMGAASMTLTVQARQLLSGIVQQQNNLLRAPEAQQHLLQLTVWGIKQLQARILAVERYLKDQQLLGIWGCSGKHICCTTVPWNSSWSNKSLDEIWNNMTWMEWEREIDNYTGLIYSLIEESQNQQEKNEQELLELD

SEQ ID NO: 49 - protein, 650 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGCGKAMYAPPIEGLIKCSSNITGLLLTRDGGANNSHNETFRPGGGDMRDNWRSELYKYKVVKIEPLGVAPTRCKRRVVEREKRAIGLGAMFLGFLGAAGSTMGAASMTLTVQARQLLSGIVQQQNNLLRAPEAQQHLLQLTVWGIKQLQARILAVERYLKDQQLLGIWGCSGKHICCTTVPWNSSWSNKSLDEIWNNMTWMEWEREIDNYTGLIYSLIEESQNQQEKNEQELLELD

SEQ ID NO: 50 - protein, 834 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQGCGVGRAMYAAPIAGNITCNSNITGLLLTRDGGQNNTETFRPGGGNMKDNWRSELYKYKVVEIEPLGVAPTKAKRQVVKRERRAVGIGAVFLGFLGAAGSTMGAASITLTVQARQLLSGIVQQQNNLLRAIEAQQHLLQLTVWGIKQLQARVLAVERYLKDQQLLGLWGCSGKLICTTNVPWNSSWSNKSQDEIWNNMTWMEWEKEISNYSNIIYRLIEESQNQQEKNEQELLALDKWASLWNWFDISNWLWYIKIFIMIVGGLIGLRIVFAVLSIVNRVRKGYSPLSLQTLIPSPREPDRPEGIEEGGGEQGKDRSVRLVNGFLALVWDDLRNLCLFSYRHLRDFILIAARIVDRGLRRGWEALKYLGNLTQYWSQELKNSAISLLNTTAIVVAEGTDRVIEALQRAGRAVLNIPRRIRQGLERALL

SEQ ID NO: 51 - protein, 834 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGCGRAMYAAPIAGNITCNSNITGLLLTRDGGQNNTETFRPGGGNMKDNWRSELYKYKVVEIEPLGVAPTKAKRQVVKRERRAVGIGAVFLGFLGAAGSTMGAASITLTVQARQLLSGIVQQQNNLLRAIEAQQHLLQLTVWGIKQLQARVLAVERYLKDQQLLGLWGCSGKLICTTNVPWNSSWSNKSQDEIWNNMTWMEWEKEISNYSNIIYRLIEESQNQQEKNEQELLALDKWASLWNWFDISNWLWYIKIFIMIVGGLIGLRIVFAVLSIVNRVRKGYSPLSLQTLIPSPREPDRPEGIEEGGGEQGKDRSVRLVNGFLALVWDDLRNLCLFSYRHLRDFILIAARIVDRGLRRGWEALKYLGNLTQYWSQELKNSAISLLNTTAIVVAEGTDRVIEALQRAGRAVLNIPRRIRQGLERALL

SEQ ID NO: 52 - protein, 642 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQGCGVGRAMYAAPIAGNITCNSNITGLLLTRDGGQNNTETFRPGGGNMKDNWRSELYKYKVVEIEPLGVAPTKCKRQVVKRERRAVGIGAVFLGFLGAAGSTMGAASITLTVQARQLLSGIVQQQNNLLRAPEAQQHLLQLTVWGIKQLQARVLAVERYLKDQQLLGLWGCSGKLICCTNVPWNSSWSNKSQDEIWNNMTWMEWEKEISNYSNIIYRLIEESQNQQEKNEQELLALD

SEQ ID NO: 53 - protein, 642 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGCGRAMYAAPIAGNITCNSNITGLLLTRDGGQNNTETFRPGGGNMKDNWRSELYKYKVVEIEPLGVAPTKCKRQVVKRERRAVGIGAVFLGFLGAAGSTMGAASITLTVQARQLLSGIVQQQNNLLRAPEAQQHLLQLTVWGIKQLQARVLAVERYLKDQQLLGLWGCSGKLICCTNVPWNSSWSNKSQDEIWNNMTWMEWEKEISNYSNIIYRLIEESQNQQEKNEQELLALD

SEQ ID NO: 54 - protein, 833 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQGCGVGRAMYAPPIAGQIQCNSNITGLLLTRDGGKNGSETLRPGGGDMRDNWRSELYKYKVVKIEPLGVAPTKAKRQVVQREKRAVGIGAVLLGFLGAAGSTMGAASITLTVQARQLLSGIVQQQSNLLKAIEAQQHLLQLTVWGIKQLQARILAVERYLKDQQLLGIWGCSGKLICTTNVPWNSSWSNKSQDEIWDNMTWMQWEKEISNYTDTIYRLIEDAQNQQEKNEQDLLALDKWDNLWSWFTITNWLWYIKIFIMIVGGLIGLRIVFAVLSVVNRVRQGYSPLSLQTLIPNPRGPERPGGIEEEGGEQDRDRSIRLVSGFLALAWDDLRSLCLFSYRHLRDFILIAARTVDMGLKRGWEALKYLWNLPQYWGQELKNSAISLLDTTAIAVAEGTDRIIEVLQRAGRAVLHIPRRIRQGFERALL

SEQ ID NO: 55 - protein, 833 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGCGRAMYAPPIAGQIQCNSNITGLLLTRDGGKNGSETLRPGGGDMRDNWRSELYKYKVVKIEPLGVAPTKAKRQVVQREKRAVGIGAVLLGFLGAAGSTMGAASITLTVQARQLLSGIVQQQSNLLKAIEAQQHLLQLTVWGIKQLQARILAVERYLKDQQLLGIWGCSGKLICTTNVPWNSSWSNKSQDEIWDNMTWMQWEKEISNYTDTIYRLIEDAQNQQEKNEQDLLALDKWDNLWSWFTITNWLWYIKIFIMIVGGLIGLRIVFAVLSVVNRVRQGYSPLSLQTLIPNPRGPERPGGIEEEGGEQDRDRSIRLVSGFLALAWDDLRSLCLFSYRHLRDFILIAARTVDMGLKRGWEALKYLWNLPQYWGQELKNSAISLLDTTAIAVAEGTDRIIEVLQRAGRAVLHIPRRIRQGFERALL

SEQ ID NO: 56 - protein, 641 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQGCGVGRAMYAPPIAGQIQCNSNITGLLLTRDGGKNGSETLRPGGGDMRDNWRSELYKYKVVKIEPLGVAPTKCKRQVVQREKRAVGIGAVLLGFLGAAGSTMGAASITLTVQARQLLSGIVQQQSNLLKAPEAQQHLLQLTVWGIKQLQARILAVERYLKDQQLLGIWGCSGKLICCTNVPWNSSWSNKSQDEIWDNMTWMQWEKEISNYTDTIYRLIEDAQNQQEKNEQDLLALD

SEQ ID NO: 57 - protein, 641 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGCGRAMYAPPIAGQIQCNSNITGLLLTRDGGKNGSETLRPGGGDMRDNWRSELYKYKVVKIEPLGVAPTKCKRQVVQREKRAVGIGAVLLGFLGAAGSTMGAASITLTVQARQLLSGIVQQQSNLLKAPEAQQHLLQLTVWGIKQLQARILAVERYLKDQQLLGIWGCSGKLICCTNVPWNSSWSNKSQDEIWDNMTWMQWEKEISNYTDTIYRLIEDAQNQQEKNEQDLLALA

SEQ ID NO: 58 - protein, 641 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGCGRAMYAPPIAGQIQCNSNITGLLLTRDGGKNGSETLRPGGGDMRDNWRSELYKYKVVKIEPLGVAPTKCKRQVVQREKRAVGIGAVLLGFLGAAGSTMGAASITLTVQARQLLSGIVQQQSNLLKAPEAQQHLLQLTVWGIKQLQARILAVERYLKDQQLLGIWGCSGKLICCTNVPWNSSWSNKSQDEIWDNMTWMQWEKEISNYTDTIYRLIEDAQNQQEKNEQDLLALD

SEQ ID NO: 59 - protein, 849 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQGCGVGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALA

SEQ ID NO: 60 - protein, 849 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQGCGVGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 61 - protein, 849 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGCGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 62 - protein, 657 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQGCGVGKAMYAPPIRGQIRCSSNITGLLLTRDGGINENGTEIFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 63 - protein, 657 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGCGKAMYAPPIRGQIRCSSNITGLLLTRDGGINENGTEIFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 64 - protein, 857 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQGCGVGRAMYAPPIRGQIRCSSNITGLLLTRDGGPEDNKTEVFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQHLLQLTVWGIKQLQARVLAVERYLRDQQLLGIWGCSGKLICTTAVPWNASWSNKSLNKIWDNMTWMEWDREINNYTSIIYSLIEESQNQQEKNEQELLELDKWASLWNWFEITEWLWYIKIFIMIIGGLIGLRIVFSVLSIMNRVRQGYSPLSFQTHLPASRGPDRPGGIEEEGGERDRDRSGRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 65 - protein, 857 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQKVGCGRAMYAPPIRGQIRCSSNITGLLLTRDGGPEDNKTEVFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQHLLQLTVWGIKQLQARVLAVERYLRDQQLLGIWGCSGKLICTTAVPWNASWSNKSLNKIWDNMTWMEWDREINNYTSIIYSLIEESQNQQEKNEQELLELDKWASLWNWFEITEWLWYIKIFIMIIGGLIGLRIVFSVLSIMNRVRQGYSPLSFQTHLPASRGPDRPGGIEEEGGERDRDRSGRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 66 - protein, 665 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQGCGVGRAMYAPPIRGQIRCSSNITGLLLTRDGGPEDNKTEVFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQHLLQLTVWGIKQLQARVLAVERYLRDQQLLGIWGCSGKLICCTAVPWNASWSNKSLNKIWDNMTWMEWDREINNYTSIIYSLIEESQNQQEKNEQELLELD

SEQ ID NO: 67 - protein, 665 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQKVGCGRAMYAPPIRGQIRCSSNITGLLLTRDGGPEDNKTEVFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQHLLQLTVWGIKQLQARVLAVERYLRDQQLLGIWGCSGKLICCTAVPWNASWSNKSLNKIWDNMTWMEWDREINNYTSIIYSLIEESQNQQEKNEQELLELD

SEQ ID NO: 68 - protein, 856 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQGCGVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGAASMTLTVQARQLLSDIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSIVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVNLLNATAIAVAEGTDRVIEVLQAAYRAIRHIPRRIRQGLERILL

SEQ ID NO: 69 - protein, 856 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQKVGCGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGAASMTLTVQARQLLSDIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSIVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVNLLNATAIAVAEGTDRVIEVLQAAYRAIRHIPRRIRQGLERILL

SEQ ID NO: 70 - protein, 664 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQGCGVGKAMYAPPISGQIRCSSNITGLLLTRDGGNNNNGSEIFRPGGGDMRDNWRSELYKYKVVKIEPLGVAPTKCKRRVVQREKRAVGIGALFLGFLGAAGSTMGAASMTLTVQARQLLSDIVQQQNNLLRAPEAQQHLLQLTVWGIKQLQARILAVERYLKDQQLLGIWGCSGKLICCTAVPWNASWSNKSLEQIWNNMTWMEWDREINNYTSLIHSLIEESQNQQEKNEQELLELD

SEQ ID NO: 71 - protein, 664 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQKVGCGKAMYAPPISGQIRCSSNITGLLLTRDGGNNNNGSEIFRPGGGDMRDNWRSELYKYKVVKIEPLGVAPTKCKRRVVQREKRAVGIGALFLGFLGAAGSTMGAASMTLTVQARQLLSDIVQQQNNLLRAPEAQQHLLQLTVWGIKQLQARILAVERYLKDQQLLGIWGCSGKLICCTAVPWNASWSNKSLEQIWNNMTWMEWDREINNYTSLIHSLIEESQNQQEKNEQELLELD

SEQ ID NO: 72 - protein, 870 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQGCGVGKAMYAPPIRGQINCSSNITGLLLTRDGGESNKTIEVFRPGGGDMRDNWRSELYKYKVVKIEPLGVAPTKAKRRVVQREKRAVGLGALFVGFLGAAGSTMGAASITLTVQARQLLSGIVQQQNNLLRAIEAQQHLLQLTVWGVKQLQARVLAVERYLKDQQLLGLWGCSGKLICTTAVPWNTSWSNKSYDYIWDNMTWMQWEREIDNYTGVIYKLIEESQNQQEKNEQELLALDKWANLWNWFDITRWLWYIKIFIMIVGGLVGLRIVFAVLSIVNRVRQGYSPLSLQTHFPAPRGPDRPEGTEEEGGDRDRDRSTPLVDGFLAIIWVDLRSLFLFSYHRLRDLLLIVTRIVELLGRRGWEALKYWWNLLQYWSQELRNSAVSLFNATAIAVAEGTDRVIEAVQRIGRAILHIPRRIRQGFERALQ

SEQ ID NO: 73 - protein, 870 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQEVGCGKAMYAPPIRGQINCSSNITGLLLTRDGGESNKTIEVFRPGGGDMRDNWRSELYKYKVVKIEPLGVAPTKAKRRVVQREKRAVGLGALFVGFLGAAGSTMGAASITLTVQARQLLSGIVQQQNNLLRAIEAQQHLLQLTVWGVKQLQARVLAVERYLKDQQLLGLWGCSGKLICTTAVPWNTSWSNKSYDYIWDNMTWMQWEREIDNYTGVIYKLIEESQNQQEKNEQELLALDKWANLWNWFDITRWLWYIKIFIMIVGGLVGLRIVFAVLSIVNRVRQGYSPLSLQTHFPAPRGPDRPEGTEEEGGDRDRDRSTPLVDGFLAIIWVDLRSLFLFSYHRLRDLLLIVTRIVELLGRRGWEALKYWWNLLQYWSQELRNSAVSLFNATAIAVAEGTDRVIEAVQRIGRAILHIPRRIRQGFERALQ

SEQ ID NO: 74 - protein, 678 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQGCGVGKAMYAPPIRGQINCSSNITGLLLTRDGGESNKTIEVFRPGGGDMRDNWRSELYKYKVVKIEPLGVAPTKCKRRVVQREKRAVGLGALFVGFLGAAGSTMGAASITLTVQARQLLSGIVQQQNNLLRAPEAQQHLLQLTVWGVKQLQARVLAVERYLKDQQLLGLWGCSGKLICCTAVPWNTSWSNKSYDYIWDNMTWMQWEREIDNYTGVIYKLIEESQNQQEKNEQELLALD

SEQ ID NO: 75 - protein, 678 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQEVGCGKAMYAPPIRGQINCSSNITGLLLTRDGGESNKTIEVFRPGGGDMRDNWRSELYKYKVVKIEPLGVAPTKCKRRVVQREKRAVGLGALFVGFLGAAGSTMGAASITLTVQARQLLSGIVQQQNNLLRAPEAQQHLLQLTVWGVKQLQARVLAVERYLKDQQLLGLWGCSGKLICCTAVPWNTSWSNKSYDYIWDNMTWMQWEREIDNYTGVIYKLIEESQNQQEKNEQELLALD

SEQ ID NO: 76 - protein, 879 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQGCGVGRAMYASPIAGIITCKSNITGLLLTRDGGNKSAGIETFRPGGGNMKDNWRSELYKYKVVEIKPLGIAPTSAKRRVVEREKRAAGIGAVILGFLGAAGSTMGAASVMLTVQARQLLSGIVQQQSNLLRAIEAQQHMLQLTVWGIKQLQTRVLAIERYLKDQQLLGLWGCSGKLICTTAVPWNTSWSNKSKDEIWDNMTWMQWDREIDNYTQVIYQLLEVSQNQQEKNENDLLALDKWNSLWSWFDITKWLWYIKIFIMIVGGLIGLRIIFAVLSVVNRVRQGYSPLSFQTLIPNPRGPDRPGGIEEEGGEQDKNRSTRLVSGFLALVWDDLRSLCLFSYHRLRDFILIAARAVELLGRSSLEGLQWGWETLKYLRNLVQYWGLELKQSAINLLDTIAIQVAEGTDRIIELIQRIFRAICNIPTRIRQGFEAALQ

SEQ ID NO: 77 - protein, 879 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQRVGCGRAMYASPIAGIITCKSNITGLLLTRDGGNKSAGIETFRPGGGNMKDNWRSELYKYKVVEIKPLGIAPTSAKRRVVEREKRAAGIGAVILGFLGAAGSTMGAASVMLTVQARQLLSGIVQQQSNLLRAIEAQQHMLQLTVWGIKQLQTRVLAIERYLKDQQLLGLWGCSGKLICTTAVPWNTSWSNKSKDEIWDNMTWMQWDREIDNYTQVIYQLLEVSQNQQEKNENDLLALDKWNSLWSWFDITKWLWYIKIFIMIVGGLIGLRIIFAVLSVVNRVRQGYSPLSFQTLIPNPRGPDRPGGIEEEGGEQDKNRSTRLVSGFLALVWDDLRSLCLFSYHRLRDFILIAARAVELLGRSSLEGLQWGWETLKYLRNLVQYWGLELKQSAINLLDTIAIQVAEGTDRIIELIQRIFRAICNIPTRIRQGFEAALQ

SEQ ID NO: 78 - protein, 680 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQGCGVGRAMYASPIAGIITCKSNITGLLLTRDGGNKSAGIETFRPGGGNMKDNWRSELYKYKVVEIKPLGIAPTSCKRRVVEREKRAAGIGAVILGFLGAAGSTMGAASVMLTVQARQLLSGIVQQQSNLLRAPEAQQHMLQLTVWGIKQLQTRVLAIERYLKDQQLLGLWGCSGKLICCTAVPWNTSWSNKSKDEIWDNMTWMQWDREIDNYTQVIYQLLEVSQNQQEKNENDLLALD

SEQ ID NO: 79 - protein, 680 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQRVGCGRAMYASPIAGIITCKSNITGLLLTRDGGNKSAGIETFRPGGGNMKDNWRSELYKYKVVEIKPLGIAPTSCKRRVVEREKRAAGIGAVILGFLGAAGSTMGAASVMLTVQARQLLSGIVQQQSNLLRAPEAQQHMLQLTVWGIKQLQTRVLAIERYLKDQQLLGLWGCSGKLICCTAVPWNTSWSNKSKDEIWDNMTWMQWDREIDNYTQVIYQLLEVSQNQQEKNENDLLALD

SEQ ID NO: 80 - protein, 860 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQGCGVGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALL

SEQ ID NO: 81 - protein, 860 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGCGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALL

SEQ ID NO: 82 - protein, 661 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQGCGVGRAMYAPPIEGNITCKSNITGLLLTWDGGENSTEGVFRPGGGNMKDNWRSELYKYKVVEIKPLGVAPTKCKRKVVGREKRAVGLGAVLLGFLGAAGSTMGAASITLTVQARQLLSGIVQQQSNLLRAPEAQQHLLQLTVWGIKQLQTRVLAIERYLKDQQLLGLWGCSGKLICCTAVPWNSSWSNKSLGDIWDNMTWMQWDREISNYTNTIFRLLEDSQNQQEKNEKDLLALD

SEQ ID NO: 83 - protein, 661 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGCGRAMYAPPIEGNITCKSNITGLLLTWDGGENSTEGVFRPGGGNMKDNWRSELYKYKVVEIKPLGVAPTKCKRKVVGREKRAVGLGAVLLGFLGAAGSTMGAASITLTVQARQLLSGIVQQQSNLLRAPEAQQHLLQLTVWGIKQLQTRVLAIERYLKDQQLLGLWGCSGKLICCTAVPWNSSWSNKSLGDIWDNMTWMQWDREISNYTNTIFRLLEDSQNQQEKNEKDLLALD

SEQ ID NO: 84 - protein, 859 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKGCGAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 85 - protein, 667 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKGCGAMYAPPISGQIRCSSNITGLLLTRDGGNSNNESEIFRPGGGDMRDNWRSELYKYKVVKIEPLGVAPTKCKRRVVQREKRAVGIGALFLGFLGAAGSTMGAASMTLTVQARQLLSGIVQQQNNLLRAPEAQQHLLQLTVWGIKQLQARILAVERYLKDQQLLGIWGCSGKLICCTAVPWNASWSNKSLEQIWNHTTWMEWDREINNYTSLIHSLIEESQNQQEKNEQELLELD

SEQ ID NO: 86 - protein, 863 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQGCGAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 87 - protein, 664 aa, Artificial Sequence
  Recombinant HIV-1 Env sequence
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWCQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQGCGAMYAPPIQGVIRCVSNITGLILTRDGGSTNSTTETFRPGGGDMRDNWRSELYKYKVVKIEPLGVAPTRCKRRVVGREKRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 88 - protein, 848 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGQGCGAMYAPPIQGVIRCESNITGLLLTRDGGNNNTNETFRPGGGDMRDNWRSELYKYKVVKIEPLGVAPTRAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLWYIKIFIMIVGGLIGLRIVFAVLSVINRVRQGYSPLSFQTHTPNPRGLDRPGRIEEEGGEQGRDRSIRLVSGFLALAWDDLRSLCLFSYHRLRDFILIAARTVELLGHSSLKGLRLGWEGLKYLWNLLLYWGRELKISAINLVDTIAIAVAGWTDRVIEIGQRIGRAILHIPRRIRQGLERALL

SEQ ID NO: 89 - protein, 649 aa, Artificial Sequence
  Recombinant HIV-1 Env sequence
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWCQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGQGCGAMYAPPIQGVIRCESNITGLLLTRDGGNNNTNETFRPGGGDMRDNWRSELYKYKVVKIEPLGVAPTRCKRRVVEREKRAVGIGAVFLGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSQNEIWDNMTWLQWDKEISNYTHIIYNLIEESQNQQEKNEQDLLALD

SEQ ID NO: 90 - protein, 846 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGRGCGAMYAPPIAGVIKCTSNITGIILTRDGGNNETETFRPGGGDMRDNWRSELYKYKVVKIEPLGVAPTRAKRRVVEREKRAVGMGAVFLGFLGAAGSTMGAASITLTVQARQLLSGIVQQQSNLLKAIEAQQHLLKLTVWGIKQLQARVLALERYLQDQQLLGIWGCSGKLICATTVPWNSSWSNKTQEEIWNNMTWLQWDKEISNYTNIIYKLLEESQNQQEKNEQDLLALDKWANLWNWFNITNWLWYIRIFIMIVGGLIGLRIVIAIISVVNRVRQGYSPLSFQIPTPNPEGLDRPGRIEEGGGEQGRDRSIRLVSGFLALAWDDLRSLCLFSYHRLRDCILIAARTVELLGHSSLKGLRLGWEGLKYLWNLLLYWGRELKNSAISLLDTIAVAVAEWTDRVIEIGQRACRAILNIPRRIRQGFERALL

SEQ ID NO: 91 - protein, 647 aa, Artificial Sequence
  Recombinant HIV-1 Env sequence
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWCQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGRGCGAMYAPPIAGVIKCTSNITGIILTRDGGNNETETFRPGGGDMRDNWRSELYKYKVVKIEPLGVAPTRCKRRVVEREKRAVGMGAVFLGFLGAAGSTMGAASITLTVQARQLLSGIVQQQSNLLKAPEAQQHLLKLTVWGIKQLQARVLALERYLQDQQLLGIWGCSGKLICCTTVPWNSSWSNKTQEEIWNNMTWLQWDKEISNYTNIIYKLLEESQNQQEKNEQDLLALD

SEQ ID NO: 92 - protein, 844 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGKGCGAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 93 - protein, 652 aa, Artificial Sequence
  Recombinant HIV-1 Env sequence
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWCQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGKGCGAMYAPPIRGQIRCSSNITGLLLTRDGGNNETEIFRPGGGDMRDNWRSELYKYKVVKIEPLGVAPTKCKRRVVQREKRAVGIGAMFLGFLGAAGSTMGAASMTLTVQARQLLSGIVQQQNNLLRAPEAQQHLLQLTVWGIKQLQARVLAVERYLKDQQLLGIWGCSGKLICCTAVPWNASWSNKSLDEIWDNMTWMEWEREIDNYTSLIYTLIEESQNQQEKNEQELLELD

SEQ ID NO: 94 - protein, 838 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGRGCGAMYAPPIAGNITCKSNITGLLLTRDGGKNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 95 - protein, 639 aa, Artificial Sequence
  Recombinant HIV-1 Env sequence
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWCQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGRGCGAMYAPPIAGNITCKSNITGLLLTRDGGKNNTETFRPGGGDMRDNWRSELYKYKVVEIKPLGIAPTKCKRRVVEREKRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNKSQEDIWDNMTWMQWDREISNYTDTIYRLLEDSQNQQEKNEKDLLALD

SEQ ID NO: 96 - protein, 843 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGKGCGAMYAPPIEGLIKCSSNITGLLLTRDGGANNSHNETFRPGGGDMRDNWRSELYKYKVVKIEPLGVAPTRAKRRVVEREKRAIGLGAMFLGFLGAAGSTMGAASMTLTVQARQLLSGIVQQQNNLLRAIEAQQHLLQLTVWGIKQLQARILAVERYLKDQQLLGIWGCSGKHICTTTVPWNSSWSNKSLDEIWNNMTWMEWEREIDNYTGLIYSLIEESQNQQEKNEQELLELDKWASLWNWFSITQWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIAARIVELLGRRGWEALKYLWNLLQYWIQELKNSAISLFDTTAIAVAEGTDRVIEIVQRACRAILNIPTRIRQGLERALL

SEQ ID NO: 97 - protein, 651 aa, Artificial Sequence
  Recombinant HIV-1 Env sequence
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWCQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGKGCGAMYAPPIEGLIKCSSNITGLLLTRDGGANNSHNETFRPGGGDMRDNWRSELYKYKVVKIEPLGVAPTRCKRRVVEREKRAIGLGAMFLGFLGAAGSTMGAASMTLTVQARQLLSGIVQQQNNLLRAPEAQQHLLQLTVWGIKQLQARILAVERYLKDQQLLGIWGCSGKHICCTTVPWNSSWSNKSLDEIWNNMTWMEWEREIDNYTGLIYSLIEESQNQQEKNEQELLELD

SEQ ID NO: 98 - protein, 835 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGRGCGAMYAAPIAGNITCNSNITGLLLTRDGGQNNTETFRPGGGNMKDNWRSELYKYKVVEIEPLGVAPTKAKRQVVKRERRAVGIGAVFLGFLGAAGSTMGAASITLTVQARQLLSGIVQQQNNLLRAIEAQQHLLQLTVWGIKQLQARVLAVERYLKDQQLLGLWGCSGKLICTTNVPWNSSWSNKSQDEIWNNMTWMEWEKEISNYSNIIYRLIEESQNQQEKNEQELLALDKWASLWNWFDISNWLWYIKIFIMIVGGLIGLRIVFAVLSIVNRVRKGYSPLSLQTLIPSPREPDRPEGIEEGGGEQGKDRSVRLVNGFLALVWDDLRNLCLFSYRHLRDFILIAARIVDRGLRRGWEALKYLGNLTQYWSQELKNSAISLLNTTAIVVAEGTDRVIEALQRAGRAVLNIPRRIRQGLERALL

SEQ ID NO: 99 - protein, 643 aa, Artificial Sequence
  Recombinant HIV-1 Env sequence
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWCQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGRGCGAMYAAPIAGNITCNSNITGLLLTRDGGQNNTETFRPGGGNMKDNWRSELYKYKVVEIEPLGVAPTKCKRQVVKRERRAVGIGAVFLGFLGAAGSTMGAASITLTVQARQLLSGIVQQQNNLLRAPEAQQHLLQLTVWGIKQLQARVLAVERYLKDQQLLGLWGCSGKLICCTNVPWNSSWSNKSQDEIWNNMTWMEWEKEISNYSNIIYRLIEESQNQQEKNEQELLALD

SEQ ID NO: 100 - protein, 834 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGRGCGAMYAPPIAGQIQCNSNITGLLLTRDGGKNGSETLRPGGGDMRDNWRSELYKYKVVKIEPLGVAPTKAKRQVVQREKRAVGIGAVLLGFLGAAGSTMGAASITLTVQARQLLSGIVQQQSNLLKAIEAQQHLLQLTVWGIKQLQARILAVERYLKDQQLLGIWGCSGKLICTTNVPWNSSWSNKSQDEIWDNMTWMQWEKEISNYTDTIYRLIEDAQNQQEKNEQDLLALDKWDNLWSWFTITNWLWYIKIFIMIVGGLIGLRIVFAVLSVVNRVRQGYSPLSLQTLIPNPRGPERPGGIEEEGGEQDRDRSIRLVSGFLALAWDDLRSLCLFSYRHLRDFILIAARTVDMGLKRGWEALKYLWNLPQYWGQELKNSAISLLDTTAIAVAEGTDRIIEVLQRAGRAVLHIPRRIRQGFERALL

SEQ ID NO: 101 - protein, 642 aa, Artificial Sequence
  Recombinant HIV-1 Env sequence
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWCQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGRGCGAMYAPPIAGQIQCNSNITGLLLTRDGGKNGSETLRPGGGDMRDNWRSELYKYKVVKIEPLGVAPTKCKRQVVQREKRAVGIGAVLLGFLGAAGSTMGAASITLTVQARQLLSGIVQQQSNLLKAPEAQQHLLQLTVWGIKQLQARILAVERYLKDQQLLGIWGCSGKLICCTNVPWNSSWSNKSQDEIWDNMTWMQWEKEISNYTDTIYRLIEDAQNQQEKNEQDLLALD

SEQ ID NO: 102 - protein, 850 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKGCGAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 103 - protein, 658 aa, Artificial Sequence
  Recombinant HIV-1 Env sequence
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKGCGAMYAPPIRGQIRCSSNITGLLLTRDGGINENGTEIFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 104 - protein, 858 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQKVGRGCGAMYAPPIRGQIRCSSNITGLLLTRDGGPEDNKTEVFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQHLLQLTVWGIKQLQARVLAVERYLRDQQLLGIWGCSGKLICTTAVPWNASWSNKSLNKIWDNMTWMEWDREINNYTSIIYSLIEESQNQQEKNEQELLELDKWASLWNWFEITEWLWYIKIFIMIIGGLIGLRIVFSVLSIMNRVRQGYSPLSFQTHLPASRGPDRPGGIEEEGGERDRDRSGRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 105 - protein, 666 aa, Artificial Sequence
  Recombinant HIV-1 Env sequence
MRVKEKYQHLWRWGWRWGTMLLGMLMICSATEKLWVTVYYGVPVWKEATTTLFCASDAKAYDTEVHNVWATHACVPTDPNPQEVELENVTENFNMWKNNMVEQMHEDIISLWCQSLKPCVKLTPLCVTLNCTDLRNATNGNDTNTTSSSREMMGGGEMKNCSFKITTNIRGKVQKEYALFYKLDIVPIDNNSNNRYRLISCNTSVITQACPKISFEPIPIHYCAPAGFAILKCKDKKFNGKGPCSNVSTVQCTHGIRPVVSTQLLLNGSLAEEEVVIRSENFADNAKTIIVQLNESVEINCTRPNNNTRKSIHIGPGRALYTTGKIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQKVGRGCGAMYAPPIRGQIRCSSNITGLLLTRDGGPEDNKTEVFRPGGGDMRDNWRSELYKYKVVKIEPLGVAPTKCKRRVVQREKRAVGIGAVFLGFLGAAGSTMGAASMTLTVQARLLLSGIVQQQNNLLRAPEAQQHLLQLTVWGIKQLQARVLAVERYLRDQQLLGIWGCSGKLICCTAVPWNASWSNKSLNKIWDNMTWMEWDREINNYTSIIYSLIEESQNQQEKNEQELLELD

SEQ ID NO: 106 - protein, 857 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQKVGKGCGAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGAASMTLTVQARQLLSDIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSIVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVNLLNATAIAVAEGTDRVIEVLQAAYRAIRHIPRRIRQGLERILL

SEQ ID NO: 107 - protein, 665 aa, Artificial Sequence
  Recombinant HIV-1 Env sequence
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWCQSLKPCVKLTPLCVSLKCTDLKNDTNTNSSSGRMIMEKGEIKNCSFNISTSIRDKVQKEYAFFYKLDIVPIDNTSYRLISCNTSVITQACPKVSFEPIPIHYCAPAGFAILKCNNKTFNGTGPCTNVSTVQCTHGIRPVVSTQLLLNGSLAEEDVVIRSANFTDNAKTIIVQLNTSVEINCTRPNNYTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQKVGKGCGAMYAPPISGQIRCSSNITGLLLTRDGGNNNNGSEIFRPGGGDMRDNWRSELYKYKVVKIEPLGVAPTKCKRRVVQREKRAVGIGALFLGFLGAAGSTMGAASMTLTVQARQLLSDIVQQQNNLLRAPEAQQHLLQLTVWGIKQLQARILAVERYLKDQQLLGIWGCSGKLICCTAVPWNASWSNKSLEQIWNNMTWMEWDREINNYTSLIHSLIEESQNQQEKNEQELLELD

SEQ ID NO: 108 - protein, 871 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQEVGKGCGAMYAPPIRGQINCSSNITGLLLTRDGGESNKTIEVFRPGGGDMRDNWRSELYKYKVVKIEPLGVAPTKAKRRVVQREKRAVGLGALFVGFLGAAGSTMGAASITLTVQARQLLSGIVQQQNNLLRAIEAQQHLLQLTVWGVKQLQARVLAVERYLKDQQLLGLWGCSGKLICTTAVPWNTSWSNKSYDYIWDNMTWMQWEREIDNYTGVIYKLIEESQNQQEKNEQELLALDKWANLWNWFDITRWLWYIKIFIMIVGGLVGLRIVFAVLSIVNRVRQGYSPLSLQTHFPAPRGPDRPEGTEEEGGDRDRDRSTPLVDGFLAIIWVDLRSLFLFSYHRLRDLLLIVTRIVELLGRRGWEALKYWWNLLQYWSQELRNSAVSLFNATAIAVAEGTDRVIEAVQRIGRAILHIPRRIRQGFERALQ

SEQ ID NO: 109 - protein, 679 aa, Artificial Sequence
  Recombinant HIV-1 Env sequence
MRVRGIRKNCQCLWGWSNMMLLGILMICSVTGNLWVTVYYGVPVWKEANTTLFCASDAKGYDTEKHNVWATHACVPTDPNPQEVLLGNNVTENFNMWKNNMVEQMHEDIISLWCQSLKPCVKLTPLCVTLNCTDLTKNSTTNNSTATNNTTNNSTEKMEMDKGEMKNCSFNITTNIRDKMQKEYALLYKLDIVPIDNGKNNSNTNYRLISCNTSVITQSCPKVSFQPIPIHYCAPAGFAILKCNNKTFNGSGPCTNVSSVQCTHGIRPVVSTQLLLNGSLAEEEIVIRSANFSDNTKTIIVQLKEAVEINCTRPNNNTRKSINIGPGRAFYATGNIIGDIRQAHCNISRTKWNNTLTEIAKKLNKQYENRTIAFNQSSGGDLEIVMHSFNCGGEFFYCNTSQLFRDTWNNTWNGIWNNDTEVNETITLPCRIKQIINMWQEVGKGCGAMYAPPIRGQINCSSNITGLLLTRDGGESNKTIEVFRPGGGDMRDNWRSELYKYKVVKIEPLGVAPTKCKRRVVQREKRAVGLGALFVGFLGAAGSTMGAASITLTVQARQLLSGIVQQQNNLLRAPEAQQHLLQLTVWGVKQLQARVLAVERYLKDQQLLGLWGCSGKLICCTAVPWNTSWSNKSYDYIWDNMTWMQWEREIDNYTGVIYKLIEESQNQQEKNEQELLALD

SEQ ID NO: 110 - protein, 880 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQRVGRGCGAMYASPIAGIITCKSNITGLLLTRDGGNKSAGIETFRPGGGNMKDNWRSELYKYKVVEIKPLGIAPTSAKRRVVEREKRAAGIGAVILGFLGAAGSTMGAASVMLTVQARQLLSGIVQQQSNLLRAIEAQQHMLQLTVWGIKQLQTRVLAIERYLKDQQLLGLWGCSGKLICTTAVPWNTSWSNKSKDEIWDNMTWMQWDREIDNYTQVIYQLLEVSQNQQEKNENDLLALDKWNSLWSWFDITKWLWYIKIFIMIVGGLIGLRIIFAVLSVVNRVRQGYSPLSFQTLIPNPRGPDRPGGIEEEGGEQDKNRSTRLVSGFLALVWDDLRSLCLFSYHRLRDFILIAARAVELLGRSSLEGLQWGWETLKYLRNLVQYWGLELKQSAINLLDTIAIQVAEGTDRIIELIQRIFRAICNIPTRIRQGFEAALQ

SEQ ID NO: 111 - protein, 681 aa, Artificial Sequence
  Recombinant HIV-1 Env sequence
MRVMGILRNWQQWWIWGILGFWMLMICNMEQLWVTVYYGVPVWKEAKATLFCASDAKAYEKEVHNVWATHACVPTDPNPQEIPLGNVTENFNMWKNDMADQMHEDIISLWCQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQRVGRGCGAMYASPIAGIITCKSNITGLLLTRDGGNKSAGIETFRPGGGNMKDNWRSELYKYKVVEIKPLGIAPTSCKRRVVEREKRAAGIGAVILGFLGAAGSTMGAASVMLTVQARQLLSGIVQQQSNLLRAPEAQQHMLQLTVWGIKQLQTRVLAIERYLKDQQLLGLWGCSGKLICCTAVPWNTSWSNKSKDEIWDNMTWMQWDREIDNYTQVIYQLLEVSQNQQEKNENDLLALD

SEQ ID NO: 112 - protein, 861 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRGCGAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALL

SEQ ID NO: 113 - protein, 662 aa, Artificial Sequence
  Recombinant HIV-1 Env sequence
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWCQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRGCGAMYAPPIEGNITCKSNITGLLLTWDGGENSTEGVFRPGGGNMKDNWRSELYKYKVVEIKPLGVAPTKCKRKVVGREKRAVGLGAVLLGFLGAAGSTMGAASITLTVQARQLLSGIVQQQSNLLRAPEAQQHLLQLTVWGIKQLQTRVLAIERYLKDQQLLGLWGCSGKLICCTAVPWNSSWSNKSLGDIWDNMTWMQWDREISNYTNTIFRLLEDSQNQQEKNEKDLLALD

SEQ ID NO: 114 - DNA, 2010 bp, Artificial Sequence
  Recombinant HIV-1 Env sequence
atggacgctatgaaaagggggctgtgctgtgtgctgctgctgtgcggggctgtgtttgtgtcacccagtcaggaaatccacgccagattccggagaggagctagggcagaaaacctgtgggtgacagtctactatggcgtgcctgtctggaaggacgccgagaccacactgttttgcgcttccgatgccaaggcttacgaaactgagaaacacaatgtgtgggctacccatgcatgtgtcccaacagacccaaacccccaggaaatccacctggagaatgtgaccgaggaattcaacatgtggaagaacaatatggtggagcagatgcatacagacatcatttccctgtgggatcagtctctgaagccttgcgtgaaactgaccccactgtgcgtcacactccagtgtacaaacgtgactaacaatatcaccgacgatatgcgcggagaactgaagaattgttctttcaacatgactaccgagctgagggacaagaaacagaaagtgtacagtctgttttatcgcctggatgtggtccagatcaatgaaaaccaggggaatagaagtaacaattcaaacaaggagtacaggctgatcaattgcaacaccagtgccattacacaggcttgtccaaaagtgtcatttgaacctatcccaattcattattgcgcacctgccggcttcgccatcctgaagtgtaaagataagaagttcaacggcactgggccctgcccttcagtgagcactgtccagtgtacccacgggattaagcctgtggtctccacccagctgctgctgaatggatctctggccgaggaagaagtgatgatccggtctgagaacatcactaacaacgctaagaacatcctggtgcagttcaacacccccgtccagattaattgcactagacctaacaataacaccaggaaatctatccgcattggacccggccaggccttttatgctaccggcgacatcattggggatatccggcaggcacactgtaatgtgagcaaggctacatggaacgagactctggggaaggtggtcaaacagctgcgcaaacatttcggaaataacaccatcattcgatttgccaatagctccggcggggacctggaagtgacaactcacagcttcaactgcggaggcgagttcttttactgtaacacaagtggcctgtttaattcaacttggatcagcaacacctccgtgcagggctctaattctaccggctctaacgatagtatcacactgccatgccggattaagcagatcattaatatgtggcagagaatcgggcaggcaatgtatgccccccctatccagggagtgattcgatgtgtcagcaatatcacaggcctgattctgactagagacgggggatcaacaaacagcaccacagagactttcaggcccggcgggggagacatgcgagataactggcggtccgaactgtacaagtataaagtggtcaagatcgagccactgggagtggcaccaacccgatgcaaaaggcgagtggtcggacgacgaagaaggcgacgagctgtggggattggagcagtcttcctgggctttctgggggccgctggatctacaatgggcgcagccagtatgactctgaccgtccaggccaggaatctgctgtcagggatcgtgcagcagcagagcaacctgctgcgcgctcccgaagcacagcagcatctgctgaagctgaccgtgtggggcatcaagcagctccaggcacgagtgctggcagtcgagcggtacctgagagatcagcagctgctgggaatctgggggtgcagcggaaagctgatttgctgtaccaatgtgccttggaactctagttggagcaatagaaacctgtccgaaatctgggacaatatgacatggctccagtgggataaggagattagcaactacactcagatcatctacggcctgctggaagagtcccagaatcagcaggagaagaacgagcaggacctgctggccctggattga

SEQ ID NO: 115 - DNA, 2016 bp, Artificial Sequence
  Recombinant HIV-1 Env sequence
atggacgctatgaaaagggggctgtgctgtgtgctgctgctgtgcggggctgtgtttgtgtcacccagtcaggaaatccacgccagattccggagaggagctagggcagaaaacctgtgggtgacagtctactatggcgtgcctgtctggaaggacgccgagaccacactgttttgcgcttccgatgccaaggcttacgaaactgagaaacacaatgtgtgggctacccatgcatgtgtcccaacagacccaaacccccaggaaatccacctggagaatgtgaccgaggaattcaacatgtggaagaacaatatggtggagcagatgcatacagacatcatttccctgtggtgccagtctctgaagccttgcgtgaaactgaccccactgtgcgtcacactccagtgtacaaacgtgactaacaatatcaccgacgatatgcgcggagaactgaagaattgttctttcaacatgactaccgagctgagggacaagaaacagaaagtgtacagtctgttttatcgcctggatgtggtccagatcaatgaaaaccaggggaatagaagtaacaattcaaacaaggagtacaggctgatcaattgcaacaccagtgccattacacaggcttgtccaaaagtgtcatttgaacctatcccaattcattattgcgcacctgccggcttcgccatcctgaagtgtaaagataagaagttcaacggcactgggccctgcccttcagtgagcactgtccagtgtacccacgggattaagcctgtggtctccacccagctgctgctgaatggatctctggccgaggaagaagtgatgatccggtctgagaacatcactaacaacgctaagaacatcctggtgcagttcaacacccccgtccagattaattgcactagacctaacaataacaccaggaaatctatccgcattggacccggccaggccttttatgctaccggcgacatcattggggatatccggcaggcacactgtaatgtgagcaaggctacatggaacgagactctggggaaggtggtcaaacagctgcgcaaacatttcggaaataacaccatcattcgatttgccaatagctccggcggggacctggaagtgacaactcacagcttcaactgcggaggcgagttcttttactgtaacacaagtggcctgtttaattcaacttggatcagcaacacctccgtgcagggctctaattctaccggctctaacgatagtatcacactgccatgccggattaagcagatcattaatatgtggcagggctgcggcatcgggcaggcaatgtatgccccccctatccagggagtgattcgatgtgtcagcaatatcacaggcctgattctgactagagacgggggatcaacaaacagcaccacagagactttcaggcccggcgggggagacatgcgagataactggcggtccgaactgtacaagtataaagtggtcaagatcgagccactgggagtggcaccaacccgatgcaaaaggcgagtggtcggacgacgaagaaggcgacgagctgtggggattggagcagtcttcctgggctttctgggggccgctggatctacaatgggcgcagccagtatgactctgaccgtccaggccaggaatctgctgtcagggatcgtgcagcagcagagcaacctgctgcgcgctcccgaagcacagcagcatctgctgaagctgaccgtgtggggcatcaagcagctccaggcacgagtgctggcagtcgagcggtacctgagagatcagcagctgctgggaatctgggggtgcagcggaaagctgatttgctgtaccaatgtgccttggaactctagttggagcaatagaaacctgtccgaaatctgggacaatatgacatggctccagtgggataaggagattagcaactacactcagatcatctacggcctgctggaagagtcccagaatcagcaggagaagaacgagcaggacctgctggccctggattga

SEQ ID NO: 116 - DNA, 2016 bp, Artificial Sequence
  Recombinant HIV-1 Env sequence
  misc_feature (1209)..(1209): n is a, c, g, or t
atggacgctatgaaaagggggctgtgctgtgtgctgctgctgtgcggggctgtgtttgtgtcacccagtcaggaaatccacgccagattccggagaggagctagggcagaaaacctgtgggtgacagtctactatggcgtgcctgtctggaaggacgccgagaccacactgttttgcgcttccgatgccaaggcttacgaaactgagaaacacaatgtgtgggctacccatgcatgtgtcccaacagacccaaacccccaggaaatccacctggagaatgtgaccgaggaattcaacatgtggaagaacaatatggtggagcagatgcatacagacatcatttccctgtggtgccagtctctgaagccttgcgtgaaactgaccccactgtgcgtcacactccagtgtacaaacgtgactaacaatatcaccgacgatatgcgcggagaactgaagaattgttctttcaacatgactaccgagctgagggacaagaaacagaaagtgtacagtctgttttatcgcctggatgtggtccagatcaatgaaaaccaggggaatagaagtaacaattcaaacaaggagtacaggctgatcaattgcaacaccagtgccattacacaggcttgtccaaaagtgtcatttgaacctatcccaattcattattgcgcacctgccggcttcgccatcctgaagtgtaaagataagaagttcaacggcactgggccctgcccttcagtgagcactgtccagtgtacccacgggattaagcctgtggtctccacccagctgctgctgaatggatctctggccgaggaagaagtgatgatccggtctgagaacatcactaacaacgctaagaacatcctggtgcagttcaacacccccgtccagattaattgcactagacctaacaataacaccaggaaatctatccgcattggacccggccaggccttttatgctaccggcgacatcattggggatatccggcaggcacactgtaatgtgagcaaggctacatggaacgagactctggggaaggtggtcaaacagctgcgcaaacatttcggaaataacaccatcattcgatttgccaatagctccggcggggacctggaagtgacaactcacagcttcaactgcggaggcgagttcttttactgtaacacaagtggcctgtttaattcaacttggatcagcaacacntccgtgcagggctctaattctaccggctctaacgatagtatcacactgccatgccggattaagcagatcattaatatgtggcagagaatcgggtgcggccaggcaatgtatgccccccctatccagggagtgattcgatgtgtcagcaatatcacaggcctgattctgactagagacgggggatcaacaaacagcaccacagagactttcaggcccggcgggggagacatgcgagataactggcggtccgaactgtacaagtataaagtggtcaagatcgagccactgggagtggcaccaacccgatgcaaaaggcgagtggtcggacgacgaagaaggcgacgagctgtggggattggagcagtcttcctgggctttctgggggccgctggatctacaatgggcgcagccagtatgactctgaccgtccaggccaggaatctgctgtcagggatcgtgcagcagcagagcaacctgctgcgcgctcccgaagcacagcagcatctgctgaagctgaccgtgtggggcatcaagcagctccaggcacgagtgctggcagtcgagcggtacctgagagatcagcagctgctgggaatctgggggtgcagcggaaagctgatttgctgtaccaatgtgccttggaactctagttggagcaatagaaacctgtccgaaatctgggacaatatgacatggctccagtgggataaggagattagcaactacactcagatcatctacggcctgctggaagagtcccagaatcagcaggagaagaacgagcaggacctgctggccctggattga

SEQ ID NO: 117 - protein, 4 aa, Artificial Sequence
  HIV-1 Env peptide
REKR

SEQ ID NO: 118 - protein, 6 aa, Artificial Sequence
  HIV-1 Env peptide
RRRRRR

It is claimed:

1. An immunogen, comprising:
a recombinant HIV-1 Env ectodomain trimer comprising a recombinant gp120 protein, the recombinant gp120 protein comprising a non-natural disulfide bond between a cysteine substitution at HIV-1 Env position 113, and a cysteine substitution or insertion at one of HIV-1 Env positions 428-432;
wherein the recombinant HIV-1 Env ectodomain trimer does not specifically bind to CD4.

2. The immunogen of claim 1, wherein the non-natural disulfide bond is between
cysteine substitutions at HIV-1 Env positions 113 and 429;
cysteine substitutions at HIV-1 Env positions 113 and 432; or
a cysteine substitution at HIV-1 Env position 113, and a cysteine insertion between positions 431 and 432.

3. The immunogen of claim 2, wherein the first non-natural disulfide bond is between:
the cysteine substitutions at position 113 and 429, and the recombinant gp120 protein further comprises one or two spacer amino acids inserted immediately C-terminal to the cysteine substitution at position 429, and/or immediately N-terminal to the cysteine substitution at position 429;
the cysteine substitutions at positions 113 and 432, and the recombinant gp120 protein further comprises one or two spacer amino acids inserted immediately C-terminal to the cysteine substitution at position 432, and/or one immediately N-terminal to the cysteine substitution at position 432; or
the cysteine substitution at position 113 and the cysteine insertion between positions 431 and 432, and the recombinant gp120 protein further comprises one or two spacer amino acids inserted immediately C-terminal to the cysteine insertion and/or immediately N-terminal to the cysteine insertion.

4. The immunogen of claim 3, wherein the spacer amino acids are a single glycine N-terminal to the cysteine substitution or insertion, and a single glycine C-terminal to the cysteine substitution or insertion.

5. The immunogen of claim 2, wherein the first non-natural disulfide bond is between cysteine residues introduced by one of:
D113C and R429GCG, E429GCG, G429GCG, or K429GCG substitutions;
D113C and Q432GCG, R432GCG, or K432GCG substitutions; or
D113C and G431GCG substitutions.

6. The immunogen of claim 1, wherein the spacer amino acids are independently selected from glycine, serine, alanine, threonine, or proline, particularly wherein the one or two spacer amino acids comprise glycine, glycine-glycine, glycine-serine, or serine-glycine.

7. The immunogen of claim 1, wherein the recombinant gp120 protein further comprises a Y61A substitution or a Y61F substitution.

8. The immunogen of claim 1, wherein the recombinant gp120 protein further comprises mutation of a glycan sequon at position N262 and/or N301.

9. The immunogen of claim 1, wherein the recombinant gp120 protein further comprises an additional non-native disulfide bond between cysteine residues introduced by A70C and L111C substitutions.

10. The immunogen of claim 1, wherein the recombinant gp120 protein comprises a non-natural disulfide bond between cysteine substitutions at HIV-1 Env positions 113 and 429, and further comprises further comprises an additional non-natural disulfide bond between cysteine substitutions at HIV-1 Env positions 201 and 433.

11. The immunogen of claim 1, wherein the recombinant gp120 protein comprises or consists of HIV-1 Env positions 31-507 (HXB2 numbering), wherein the HIV-1 Env positions correspond to the HIV-1 Env HXB2 reference sequence set forth as SEQ ID NO: 1.

12. The immunogen of claim 1, wherein the recombinant gp120 protein comprises or consists of HIV-1 Env positions 31-507 (HXB2 numbering) of any one of SEQ ID NOs: 22-113, or an amino acid sequence at least 90% identical thereto.

13. The immunogen of claim 1, wherein the HIV-1 Env ectodomain trimer is soluble.

14. The immunogen of claim 1, wherein the recombinant HIV-1 Env ectodomain trimer comprises three gp120-gp41 ectodomain protomers each comprising the recombinant gp120 protein and a gp41 ectodomain.

15. The immunogen of claim 14, wherein the recombinant gp120 proteins and gp41 ectodomains further comprise an additional non-natural disulfide bond between cysteine substitutions at HIV-1 Env position 501 and gp41 position 605, and/or a proline substitution at gp41 position 559 (SOSIP mutations).

16. The immunogen of claim 14, wherein the recombinant gp120 protein comprises or consists of HIV-1 Env positions 31-507 and the gp41 ectodomain comprises or consists of HIV-1 Env positions 512-664.

17. The immunogen of claim 14, wherein the HIV-1 Env ectodomain trimer is membrane anchored by transmembrane domains linked to a C-terminal residue of each of the gp41 ectodomains, particularly wherein the immunogen comprises full-length gp41 proteins.

18. The immunogen of claim 14, wherein:
the recombinant gp120 protein comprises or consists of HIV-1 Env positions 31-507 (HXB2 numbering) of any one of SEQ ID NOs: 22-113, or an amino acid sequence at least 90% identical thereto; and the gp41 ectodomain comprises or consists of HIV-1 Env positions 512-664 (HXB2 numbering) of any one of SEQ ID NOs: 22-113, or an amino acid sequence at least 90% identical thereto; or
the recombinant gp120 protein comprises or consists of HIV-1 Env positions 31-507 (HXB2 numbering) of any one of SEQ ID NOs: 22-113, or an amino acid sequence at least 90% identical thereto; and the full-length gp41 comprises or consists of HIV-1 Env positions 512 to the C-terminus (HXB2 numbering) of any one of SEQ ID NOs: 22-113, or an amino acid sequence at least 90% identical thereto.

19. The immunogen of claim 14, wherein the recombinant gp120 protein is linked to the gp41 ectodomain by a peptide linker, particularly wherein HIV-1 Env position 507 is linked to gp41 position 512 by the peptide linker, particularly wherein the peptide linker is a ten amino acid glycine-serine peptide linker, such as SEQ ID NO: 16.

20. The immunogen of claim 1, wherein the HIV-1 Env ectodomain trimer is stabilized in a prefusion mature closed conformation by the amino acid substitutions and/or insertions.

21. The immunogen of claim 1, wherein the recombinant HIV-1 Env ectodomain trimer is selected from one of: a Clade A HIV-1 Env ectodomain trimer, Clade B HIV-1 Env ectodomain trimer, Clade C HIV-1 Env ectodomain trimer, Clade D HIV-1 Env ectodomain trimer, or Clade F HIV-1 Env ectodomain trimer.

22. An immunogen, comprising a recombinant gp140 protein, a recombinant gp145 protein, or a recombinant gp160 protein, comprising the recombinant gp120 protein of claim 1.

23. A virus-like particle comprising the immunogen of claim 1.

24. An isolated nucleic acid molecule encoding:
a protomer of the HIV-1 Env ectodomain trimer of claim 1.

25. The nucleic acid molecule of claim 24, encoding a precursor protein of the protomer of the HIV-1 Env ectodomain trimer.

26. The nucleic acid molecule of claim 24, operably linked to a promoter.

27. An expression vector comprising the nucleic acid molecule of claim 26.

28. The expression vector of claim 27, wherein the expression vector is a viral vector, particularly wherein the viral vector is an adeno-associated virus vector.

29. A pharmaceutical composition for use in inducing an immune response to HIV-1 in a subject, comprising a therapeutically effective amount of the immunogen of claim 1, and a pharmaceutically acceptable carrier.

30. A method for inducing an immune response to HIV-1 in a subject, comprising administering to the subject a therapeutically effective amount of the immunogen of claim 1 to generate the immune response to HIV-1 in the subject.

31. The method of claim 30, wherein the immune response treats or inhibits an HIV-1 infection in the subject.

32. The method of claim 30, comprising a prime-boost administration of the immunogen.

33. The method of claim 32, wherein the prime-boost administration comprises a DNA prime and a protein boost.

* * * * *